US011596686B2

(12) United States Patent
Rauch et al.

(10) Patent No.: US 11,596,686 B2
(45) Date of Patent: *Mar. 7, 2023

(54) CORONAVIRUS VACCINE

(71) Applicant: CureVac SE, Tübingen (DE)

(72) Inventors: Susanne Rauch, Tübingen (DE); Hans Wolfgang Große, Tübingen (DE); Benjamin Petsch, Tübingen (DE)

(73) Assignee: CureVac SE, Tübingen (DE)

( * ) Notice: Subject to any disclaimer, the term of this patent is extended or adjusted under 35 U.S.C. 154(b) by 0 days.

This patent is subject to a terminal disclaimer.

(21) Appl. No.: 17/818,699

(22) Filed: Aug. 9, 2022

(65) Prior Publication Data

US 2022/0395570 A1 Dec. 15, 2022

Related U.S. Application Data

(63) Continuation of application No. 17/526,912, filed on Nov. 15, 2021, now Pat. No. 11,576,966, which is a continuation of application No. 17/276,788, filed as application No. PCT/EP2021/052455 on Feb. 3, 2021.

(60) Provisional application No. 63/129,395, filed on Dec. 22, 2020, provisional application No. 63/119,390, filed on Nov. 30, 2020, provisional application No. 63/113,159, filed on Nov. 12, 2020, provisional application No. 63/112,106, filed on Nov. 10, 2020.

(30) Foreign Application Priority Data

| Feb. 4, 2020 | (WO) | PCT/EP2020/052775 |
| Apr. 3, 2020 | (WO) | PCT/EP2020/059687 |
| May 29, 2020 | (WO) | PCT/EP2020/065091 |
| Oct. 22, 2020 | (WO) | PCT/EP2020/079831 |
| Oct. 23, 2020 | (WO) | PCT/EP2020/079973 |
| Nov. 2, 2020 | (WO) | PCT/EP2020/080713 |

(51) Int. Cl.
| A61K 39/215 | (2006.01) |
| A61K 47/26 | (2006.01) |
| A61K 9/00 | (2006.01) |
| A61P 31/14 | (2006.01) |
| A61K 39/00 | (2006.01) |

(52) U.S. Cl.
CPC .......... *A61K 39/215* (2013.01); *A61K 9/0019* (2013.01); *A61K 47/26* (2013.01); *A61P 31/14* (2018.01); *A61K 2039/53* (2013.01); *A61K 2039/6018* (2013.01); *A61K 2039/6093* (2013.01)

(58) Field of Classification Search
None
See application file for complete search history.

(56) References Cited

U.S. PATENT DOCUMENTS

| 9,364,435 B2 | 6/2016 | Yaworski et al. |
| 9,428,535 B2 | 8/2016 | de Fougerolles et al. |
| 9,476,055 B2 | 10/2016 | Sahin et al. |
| 9,504,651 B2 | 11/2016 | Maclachlan et al. |
| 9,518,272 B2 | 12/2016 | Yaworski et al. |
| 9,657,295 B2 | 9/2017 | Schrum et al. |
| 9,850,269 B2 | 12/2017 | DeRosa et al. |
| 9,868,692 B2 | 1/2018 | Benenato |
| 9,943,612 B2 | 4/2018 | Scharenberg et al. |
| 10,022,435 B2 | 7/2018 | Ciaramella et al. |
| 10,064,959 B2 | 9/2018 | Schrum et al. |
| 10,266,485 B2 | 4/2019 | Benenato |
| 10,442,756 B2 | 10/2019 | Benenato et al. |
| 10,577,403 B2 | 3/2020 | De Fougerolles et al. |
| 10,702,600 B1 | 7/2020 | Ciaramella et al. |
| 10,703,789 B2 | 7/2020 | De Fougerolles et al. |
| 10,772,975 B2 | 9/2020 | Bancel et al. |
| 10,898,574 B2 | 1/2021 | de Fougerolles et al. |
| 10,933,127 B2 | 3/2021 | Ciaramella et al. |
| 10,953,089 B1 | 3/2021 | Smith et al. |
| 11,060,107 B2 | 7/2021 | Weissman et al. |
| 11,078,242 B1 | 8/2021 | Roy et al. |
| 11,202,793 B2 | 12/2021 | Hoge et al. |
| 11,241,493 B2 | 2/2022 | Rauch et al. |
| 2005/0032730 A1 | 2/2005 | von der Mülbe et al. |

(Continued)

FOREIGN PATENT DOCUMENTS

| CN | 111228475 | 6/2020 |
| CN | 111606980 | 9/2020 |

(Continued)

OTHER PUBLICATIONS

"Pfizer and BioNTech Achieve First Authorization in the World for a Vaccine to Combat COVID-19", press release, Dec. 2, 2020.

(Continued)

*Primary Examiner* — Stacy B Chen

(74) *Attorney, Agent, or Firm* — Parker Highlander PLLC

(57) ABSTRACT

The present invention is directed to a nucleic acid suitable for use in treatment or prophylaxis of an infection with a coronavirus, preferably with a Coronavirus SARS-CoV-2, or a disorder related to such an infection, preferably COVID-19. The present invention is also directed to compositions, polypeptides, and vaccines. The compositions and vaccines preferably comprise at least one of said nucleic acid sequences, preferably nucleic acid sequences in association a lipid nanoparticle (LNP). The invention is also directed to first and second medical uses of the nucleic acid, the composition, the polypeptide, the combination, the vaccine, and the kit, and to methods of treating or preventing a coronavirus infection, preferably a Coronavirus infection.

30 Claims, 46 Drawing Sheets

Figure 1:
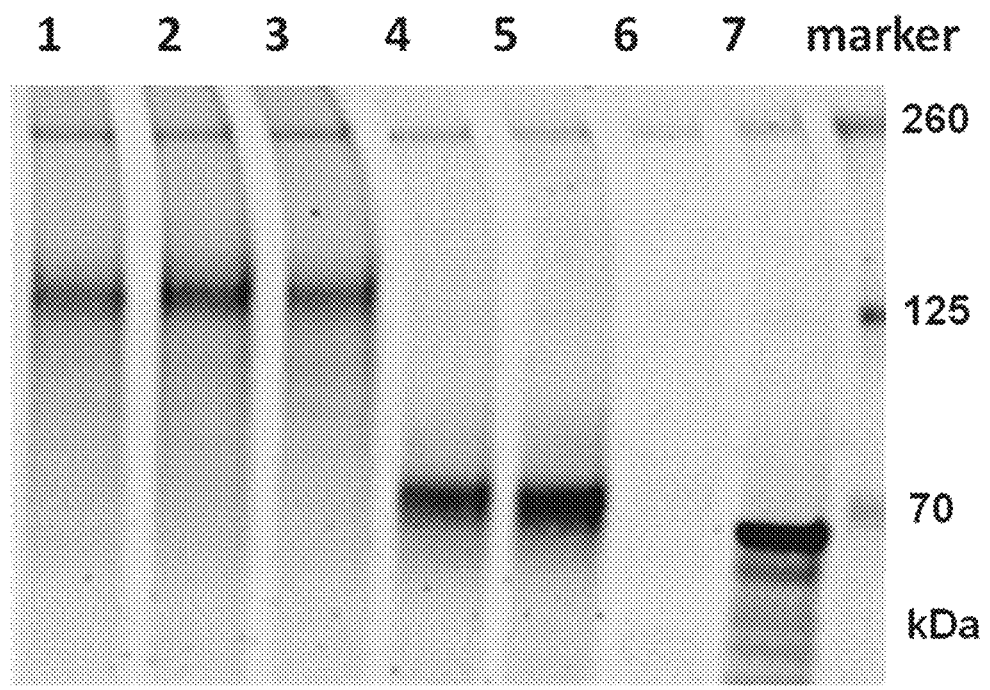

Specification includes a Sequence Listing.

(56) References Cited

U.S. PATENT DOCUMENTS

| | | |
|---|---|---|
| 2005/0059624 A1 | 3/2005 | Hoerr et al. |
| 2005/0250723 A1 | 11/2005 | Hoerr et al. |
| 2006/0188490 A1 | 8/2006 | Hoerr et al. |
| 2008/0025944 A1 | 1/2008 | Hoerr et al. |
| 2008/0267873 A1 | 10/2008 | Hoerr et al. |
| 2009/0324584 A1 | 12/2009 | Hoerr et al. |
| 2010/0048883 A1 | 2/2010 | Ketterer et al. |
| 2010/0189729 A1 | 7/2010 | Hoerr et al. |
| 2010/0203076 A1 | 8/2010 | Fotin-Mleczek et al. |
| 2010/0291156 A1 | 11/2010 | Barner et al. |
| 2010/0305196 A1 | 12/2010 | Probst et al. |
| 2011/0053829 A1 | 3/2011 | Baumhof et al. |
| 2011/0250225 A1 | 10/2011 | Fotin-Mleczek et al. |
| 2012/0021043 A1 | 1/2012 | Kramps et al. |
| 2012/0258046 A1 | 10/2012 | Mutzke |
| 2013/0129754 A1 | 5/2013 | Thess et al. |
| 2013/0142818 A1 | 6/2013 | Baumhof et al. |
| 2013/0259879 A1 | 10/2013 | Baumhof et al. |
| 2013/0280283 A1 | 10/2013 | Lorenz et al. |
| 2013/0295043 A1 | 11/2013 | Kallen et al. |
| 2013/0336998 A1 | 12/2013 | Kallen et al. |
| 2015/0037326 A1 | 2/2015 | Butler-Ransohoff et al. |
| 2015/0050302 A1 | 2/2015 | Thess |
| 2015/0057340 A1 | 2/2015 | Thess et al. |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326575 A1 | 11/2016 | von der Mülbe |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0303925 A1 | 10/2018 | Weissman et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |
| 2019/0194760 A1 | 6/2019 | Koch et al. |
| 2019/0225971 A1 | 7/2019 | Williams |
| 2019/0241633 A1 | 8/2019 | Fotin-Mleczek et al. |
| 2019/0249219 A1 | 8/2019 | Reichert et al. |
| 2019/0336608 A1 | 11/2019 | Baumhof et al. |
| 2019/0336611 A1 | 11/2019 | Baumhof et al. |
| 2019/0343933 A1 | 11/2019 | Horscroft et al. |
| 2019/0343942 A1 | 11/2019 | Fotin-Mleczek et al. |
| 2019/0351044 A1 | 11/2019 | Jasny et al. |
| 2019/0351047 A1 | 11/2019 | Jasny et al. |
| 2019/0351048 A1 | 11/2019 | Rauch |
| 2019/0381180 A1 | 12/2019 | Baumhof et al. |
| 2020/0023076 A1 | 1/2020 | Fotin-Mleczek et al. |
| 2020/0061185 A1 | 2/2020 | Graham et al. |
| 2020/0085852 A1 | 3/2020 | Fotin-Mleczek |
| 2020/0085944 A1 | 3/2020 | Heidenreich et al. |
| 2020/0149026 A1 | 5/2020 | Horscroft et al. |
| 2020/0163878 A1 | 5/2020 | Baumhof et al. |
| 2020/0179526 A1 | 6/2020 | Baumhof et al. |
| 2020/0197510 A1 | 6/2020 | Ciaramella et al. |
| 2020/0282046 A1 | 9/2020 | Ciaramella et al. |
| 2020/0318097 A1 | 10/2020 | Funkner et al. |
| 2020/0392572 A1 | 12/2020 | Yazdan Panah et al. |
| 2021/0023199 A1 | 1/2021 | Kallen et al. |
| 2021/0030864 A1 | 2/2021 | Petsch et al. |
| 2021/0030866 A1 | 2/2021 | Kallen et al. |
| 2021/0060175 A1 | 3/2021 | Fotin-Mleczek et al. |
| 2021/0162037 A1 | 6/2021 | Jasny et al. |
| 2021/0170017 A1 | 6/2021 | Lutz et al. |
| 2021/0222178 A1 | 7/2021 | Linke et al. |
| 2021/0228707 A1 | 7/2021 | Metkar et al. |
| 2021/0228708 A1 | 7/2021 | Smith et al. |
| 2021/0228709 A1 | 7/2021 | Smith et al. |
| 2021/0253645 A1 | 8/2021 | Gershoni et al. |

FOREIGN PATENT DOCUMENTS

| | | |
|---|---|---|
| CN | 111606981 | 9/2020 |
| CN | 111647053 | 9/2020 |
| CN | 111732638 | 10/2020 |
| CN | 111778264 | 10/2020 |
| CN | 111821433 | 10/2020 |
| CN | 111333704 B | 1/2021 |
| CN | 112226445 | 1/2021 |
| CN | 112266411 | 1/2021 |
| CN | 111518175 B | 2/2021 |
| CN | 112300251 | 2/2021 |
| CN | 112390863 | 2/2021 |
| EP | 3336082 | 4/2020 |
| WO | WO 2006-078294 | 7/2006 |
| WO | WO 2007-024708 | 3/2007 |
| WO | WO 2008-016473 | 2/2008 |
| WO | WO 2008-157688 | 6/2008 |
| WO | WO 2009-030481 | 3/2009 |
| WO | WO 2009-149253 | 12/2009 |
| WO | WO 2011-005799 | 1/2011 |
| WO | WO 2011-015347 | 2/2011 |
| WO | WO 2011-068810 | 6/2011 |
| WO | WO 2011-071931 | 6/2011 |
| WO | WO 2012-006369 | 1/2012 |
| WO | WO 2012-006377 | 1/2012 |
| WO | WO 2012-006378 | 1/2012 |
| WO | WO 2012-031043 | 3/2012 |
| WO | WO 2012-116810 | 9/2012 |
| WO | WO 2012-116811 | 9/2012 |
| WO | WO 2013-006825 | 1/2013 |
| WO | WO 2013-059475 | 4/2013 |
| WO | WO 2015-164674 | 10/2015 |
| WO | WO 2015-199952 | 12/2015 |
| WO | WO 2016-022914 | 2/2016 |
| WO | WO 2017-004143 | 1/2017 |
| WO | WO 2017-053297 | 3/2017 |
| WO | WO 2017-066781 | 4/2017 |
| WO | WO 2017-066782 | 4/2017 |
| WO | WO 2017-066789 | 4/2017 |
| WO | WO 2017-066791 | 4/2017 |

(56) References Cited

FOREIGN PATENT DOCUMENTS

| | | |
|---|---|---|
| WO | WO 2017-066793 | 4/2017 |
| WO | WO 2017-066797 | 4/2017 |
| WO | WO 2017-070626 | 4/2017 |
| WO | WO 2017-075531 | 5/2017 |
| WO | WO 2017-137095 | 8/2017 |
| WO | WO 2017-140905 | 8/2017 |
| WO | WO 2018-075827 | 4/2018 |
| WO | WO 2018-078053 | 5/2018 |
| WO | WO 2018-081318 | 5/2018 |
| WO | WO 2018-170347 | 9/2018 |
| WO | WO 2018-172556 | 9/2018 |
| WO | WO 2018-211038 | 11/2018 |
| WO | WO 2019-077001 | 4/2019 |
| WO | WO 2019-092153 | 5/2019 |
| WO | WO 2019-193183 | 10/2019 |
| WO | WO 2019-222424 | 11/2019 |
| WO | WO 2019-226925 | 11/2019 |
| WO | WO 2019-232095 | 12/2019 |
| WO | WO 2019-232097 | 12/2019 |
| WO | WO 2019-232208 | 12/2019 |
| WO | WO 2020-002525 | 1/2020 |
| WO | WO 2020-002598 | 1/2020 |
| WO | WO 2020-127959 | 6/2020 |
| WO | WO 2020-128031 | 6/2020 |
| WO | WO 2021-151099 | 7/2021 |
| WO | WO 2021-154828 | 8/2021 |
| WO | WO 2021-155323 | 8/2021 |
| WO | WO 2021-156267 | 8/2021 |
| WO | WO 2021-159040 | 8/2021 |
| WO | WO 2021-159985 | 8/2021 |
| WO | WO 2021-160036 | 8/2021 |
| WO | WO 2021-160346 | 8/2021 |
| WO | WO 2021-160850 | 8/2021 |
| WO | WO 2021-160881 | 8/2021 |
| WO | WO 2021-161043 | 8/2021 |
| WO | WO 2021-163222 | 8/2021 |
| WO | WO 2021-163365 | 8/2021 |
| WO | WO 2021-163371 | 8/2021 |
| WO | WO 2021-163398 | 8/2021 |
| WO | WO 2021-163427 | 8/2021 |
| WO | WO 2021-163438 | 8/2021 |
| WO | WO 2021-163456 | 8/2021 |
| WO | WO 2021-163536 | 8/2021 |
| WO | WO 2021-163584 | 8/2021 |
| WO | WO 2021-163622 | 8/2021 |
| WO | WO 2021-202734 | 10/2021 |
| WO | WO 2021-213924 | 10/2021 |
| WO | WO 2021-213945 | 10/2021 |
| WO | WO 2021-214204 | 10/2021 |
| WO | WO 2021-222304 | 11/2021 |
| WO | WO 2021-236854 | 11/2021 |
| WO | WO 2021-243122 | 12/2021 |
| WO | WO 2022-067010 | 3/2022 |
| WO | WO 2022-110099 | 6/2022 |
| WO | WO 2022-155524 | 7/2022 |
| WO | WO 2022-155530 | 7/2022 |

OTHER PUBLICATIONS

BioNTech Annual Report, "For a medicine of tomorrow" pp. 1, 24, and 70-94, 2021.
Chan et al., "A familial cluster of pneumonia associated with the 2019 novel coronavirus indicating person-to-person transmission: a study of a family cluster," Lancet 395:514-523, 2020.
GenBank Accession No. MN908947.2, "Wuhan seafood market pneumonia virus isolate Wuhan-Hu-1, complete genome," Jan. 14, 2020.
Hassett et al., "Optimization of Lipid Nanoparticles for Intramuscular Administration of mRNA Vaccines," Molecular Therapy: Nucleic Acids 15:1-11, 2019.
Lu et al., "Genomic characterisation and epidemiology of 2019 novel coronavirus: implications for virus origins and receptor binding," Lancet 395:565-574, 2020.
Office Communication issued in U.S. Appl. No. 17/546,414, dated Aug. 18, 2022.
Office Communication issued in U.S. Appl. No. 17/546,414, dated Aug. 31, 2022.
Pardi et al., "Nucleoside-modified mRNA vaccines induce potent T follicular helper and germinal center B cell responses," J. Exp. Med., 215:1571-1588, 2018.
PCT Invitation to Pay Additional Fees, Partial Search Report, and Provisional Opinion issued in International Application No. PCT/EP2021/052455, dated Apr. 29, 2021.
Programme from the 1st International mRNA Health Conference, held in Tübingen, Germany, on Oct. 23-24, 2013.
Wu et al., "A new coronavirus associated with human respiratory disease in China," Nature 579:265-269 and Online Content, 2020.
Zhang et al., "The D614G mutation in the SARS-CoV-2 spike protein reduces S1 shedding and increases infectivity," bioRxiv, doi:10.1101/2020/06/012/148726, Jun. 12, 2020.
Zhou et al., "A pneumonia outbreak associated with a new coronavirus of probable bat origin," Nature 579:270-273 and Online Content, 2020.
U.S. Appl. No. 17/829,004, filed Jun. 1, 2022, Roth et al.
"Comirnaty, Common name: COVID-19 mRNA vaccine (nucleoside-modified)," Assessment Report, European Medicines Agency, Dec. 21, 2020.
"COVID-19 vaccine moderna, Common name: COVID-19 mRNA Vaccine (nucleoside-modified)," Assessment Report, European Medicines Agency, Jan. 6, 2021.
"CureVac Final Data from Phase 2b/3 Trial of First-Generation COVID-19 Vaccine Candidate, CVnCoV, Demonstrates Protection in Age Group of 18 to 60", press release, Jun. 30, 2021.
"CureVac Provides Update on Phase 2b/3 Trial of First-Generation COVID-19 Vaccine Candidate, CVnCoV", press release, Jun. 16, 2021.
"CureVac: Final Analysis of Pivotal Phase 2b/3 HERALD Study", presentation, Jul. 1, 2021.
"CureVac: Second Interim Analysis of Pivotal Phase 2b/3 HERALD Study", presentation, Jun. 17, 2021.
"Final Analysis of Phase 2b/3 Clinical Trial of First-Generation COVID-19 Vaccine Candidate, CVnCoV", transcript of conference call, Jul. 1, 2021.
"Results of Second Interim Analysis of CureVac's Pivotal Phase 2b/3 HERALD Study", transcript of conference call, Jun. 17, 2021.
Anderson et al., "Safety and immunogenicity of SARS-CoV-2 mRNA-1273 vaccine in older adults," The New England Journal of Medicine, 383:2427-2438, 2020.
Baden et al., "Efficacy and safety of the mRNA-1273 SARS-CoV-2 vaccine," The New England Journal of Medicine, 384:403-416, 2021.
Corbett et al., "Evaluation of the mRNA-1273 vaccine against SARS-CoV-2 in nonhuman primates," The New England Journal of Medicine, 383:1544-1555, 2020.
Corbett et al., "SARS-CoV-2 mRNA vaccine development enabled by prototype pathogen preparedness," bioRxiv preprint, Jun. 11, 2020.
Dao et al., "SARS-CoV-2 Infectivity and Severity of COVID-19 According to SARS-CoV-2 Variants: Current Evidence," J. Clin. Med., 10:2635, 2021.
Database EMBL Accession No. MN908947, 2020.
Gebre et al., "Optimization of non-coding regions for a non-modified mRNA COVID-19 vaccine," Nature, 601:410-414, 2022.
Gebre et al., "Optimization of non-coding regions improves protective efficacy of an mRNA SARS-CoV-2 vaccine in nonhuman primates," bioRxiv Preprint, Aug. 16, 2021.
GenBank Accession No. MN908947.1, "Wuhan seafood market pneumonia virus isolate Wuhan-Hu-1, complete genome," Jan. 12, 2020.
Gerhardt et al., "A thermostable, flexible RNA vaccine delivery platform for pandemic response," bioRxiv preprint, Feb. 2, 2021.
Gorbalenya et al., "The species Severe acute respiratory syndrome-related coronavirus: classifying 2019-nCoV and naming it SARS-CoV-2," Nat. Microbiology, 5:536-544, 2020.

(56) References Cited

OTHER PUBLICATIONS

Hoffmann et al., "CVnCoV protects human ACE2 transgenic mice from ancestral B BavPat1 and emerging B.1.351 SARS-CoV-2," bioRxiv preprint, Mar. 22, 2021.

Huang et al., "Clinical features of patients infection 2019 novel coronavirus in Wuhan, China," *Lancet*, 395:497-506, 2020.

Jackson et al., "An mRNA vaccine against SARS-CoV-2—preliminary report," *The New England Journal of Medicine*, 383:1920-1931, 2020.

Jiang et al., "SARS vaccine development," *Emerging Infectious Diseases*, 11(7):1016-1020, 2005.

Kakodkar et al., "A comprehensive literature review on the clinical presentation, and management of the pandemic coronavirus disease 2019 (COVID-19)," *Cureus*, 12(4):e7560, 2020.

Kirchdoerfer et al., "Stabilized coronavirus spikes are resistant to conformational changes induced by receptor recognition or proteolysis," *Scientific Rep.*, 8(1):1-11, 2018.

Kusters et al., "Manufacturing vaccines for an emerging viral infection—specific issues associated with the development of a prototype SARS vaccine," Vaccine for Biodefense and Emerging and Neglected Diseases, 147-156, 2009.

Maruggi et al., "mRNA as a Transformative Technology for Vaccine Development to Control Infectious Diseases," *Mol Ther.*, 27(4):757-772, 2019.

Muik et al., "Neutralization of SARS-CoV-2 lineage B.1.1.7 pseudovirus by BNT162b2 vaccine-elicited human sera," bioRxiv preprint, Jan. 19, 2021.

NCBI Accession No. NC_045512.1, "Wuhan seafood market pneumonia virus isolate Wuhan-Hu-1, complete genome," Jan. 13, 2020.

Office Communication issued in U.S. Appl. No. 17/067,614, dated Oct. 18, 2021.

Office Communication issued in U.S. Appl. No. 17/067,614, dated Apr. 1, 2021.

Office Communication issued in U.S. Appl. No. 17/067,614, dated Dec. 10, 2020.

Office Communication issued in U.S. Appl. No. 17/067,709, dated Oct. 18, 2021.

Office Communication issued in U.S. Appl. No. 17/067,709, dated Jul. 14, 2021.

Office Communication issued in U.S. Appl. No. 17/067,709, dated Mar. 10, 2021.

Office Communication issued in U.S. Appl. No. 17/067,709, dated Nov. 27, 2020.

Office Communication issued in U.S. Appl. No. 17/090,885, dated Jun. 1, 2021.

Office Communication issued in U.S. Appl. No. 17/090,885, dated Feb. 18, 2021.

Office Communication issued in U.S. Appl. No. 17/231,261, dated Dec. 22, 2021.

Office Communication issued in U.S. Appl. No. 17/526,912, dated Jun. 20, 2022.

Office Communication issued in U.S. Appl. No. 17/546,414, dated Apr. 20, 2022.

Office Communication issued in U.S. Appl. No. 17/546,414, dated May 9, 2022.

Ou et al., "Characterization of spike glycoprotein of SARS-CoV-2 on virus entry and its immune cross-reactivity with SARS-CoV," *Nature Com.*, 11(1):1-12, 2020.

Pallesen et al., "Immunogenicity and structures of a rationally designed prefusion MERS-CoV spike antigen," PNAS, 14(35):E7348-E7357, 2017.

PCT International Search Report and Written Opinion issued in International Application No. PCT/EP2021/052455 dated Jun. 25, 2021.

Perlman et al., "Immunopathogenesis of coronavirus infections: Implications for SARS," Nature Reviews Immunology, 5:917-927, 2005.

Polack et al., "Safety and efficacy of the BNT162b2 mRNA Covid-19 vaccine," *The New England Journal of Medicine*, 383:2603-2615, 2020.

Rauch et al., "mRNA based SARS-CoV-2 vaccine candidate CVnCoV induces high levels of virus neutralizing antibodies and mediates protection in rodents," bioRxiv preprint, Feb. 9, 2021.

Rauch et al., "mRNA vaccine CVnCoV protects non-human primates from SARS-CoV-2 challenge infection," bioRxiv preprint, Dec. 23, 2020.

Rauch et al., "New vaccine technologies to combat outbreak situations," *Frontiers in Immunology*, 9:1963, 2018.

Registry Nos. 2749948-25-0, 2692611-88-2, 2758016-89-4, 2755828-88-5, 2741858-84-2, 2730004-45-0, 2696398-77-1, and 2695574-78-6, STN Database, Accessed Feb. 9, 2022.

Sahin et al., "Concurrent human antibody and $T_H1$ type T-cell responses elicited by a COVID-19 RNA vaccine," medRxiv preprint, Jul. 20, 2020.

Schrörs et al., "Large-scale analysis of SARS-CoV-2 spike-glycoprotein mutants demonstrates the need for continuous screening of virus isolates," bioRxiv preprint, Mar. 15, 2021.

U.S. Appl. No. 62/967,006, entitled "Coronavirus RNA vaccines," filed Jan. 28, 2020.

Vogel et al., "A prefusion SARS-CoV-2 spike RNA vaccine is highly immunogenic and prevents lung infection in non-human primates," bioRxiv preprint, Sep. 8, 2020.

Vogel et al., "BNT162b vaccines are immunogenic and protect non-human primates against SARS-CoV-2," bioRxiv preprint, Dec. 11, 2020.

Wang et al., "An evidence based perspective on mRNA-SARS-CoV-2 vaccine development," *Medical Science Monitor*, 26:e924700, 2020.

Widge et al., "Durability of responses after SARS-CoV-2 mRNA-1273 vaccination," *The New England Journal of Medicine*, 384:80-82, 2021.

Wrapp et al., "Cryo-EM structure of the 2019-nCoV spike in the prefusion conformation," Science, 367:1260-1263, 2020.

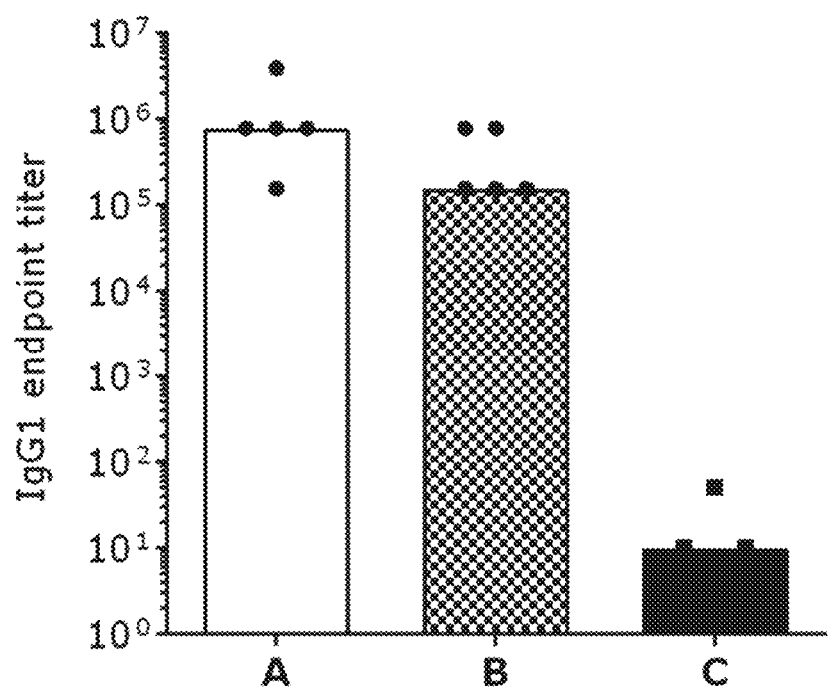
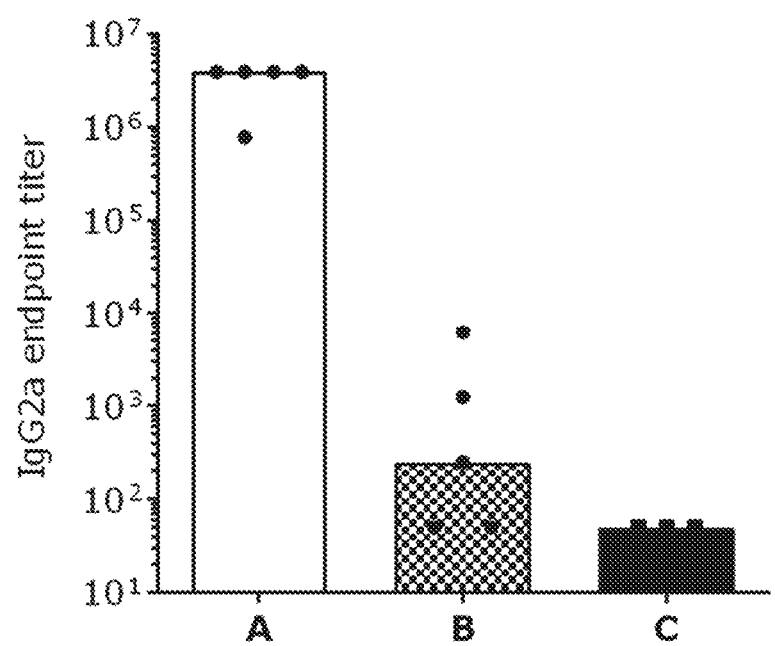
FIG. 4

Figure 5C:
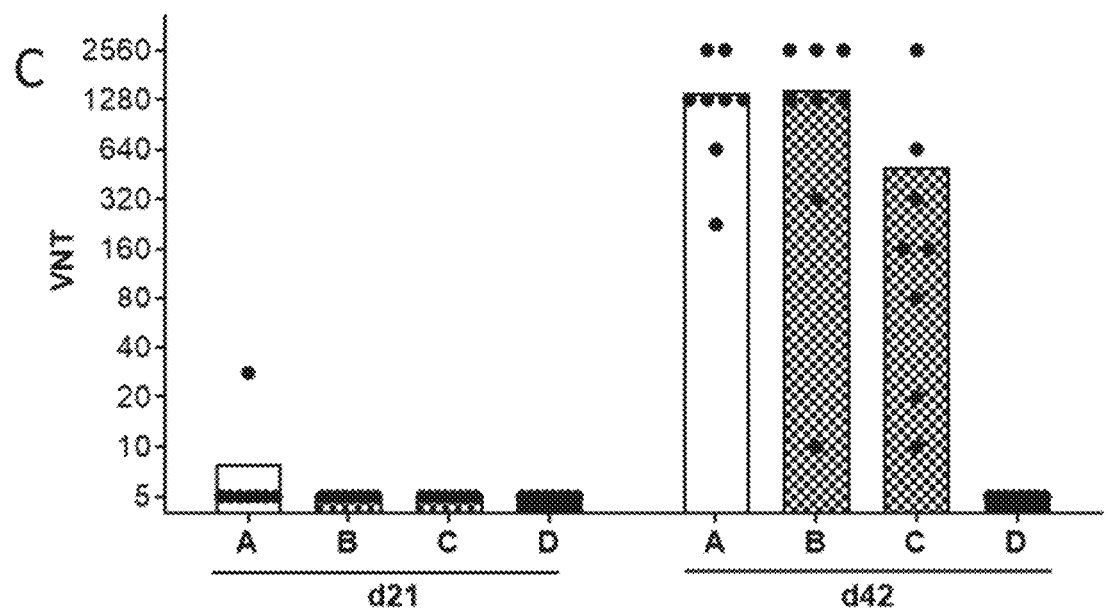
Figure 6:
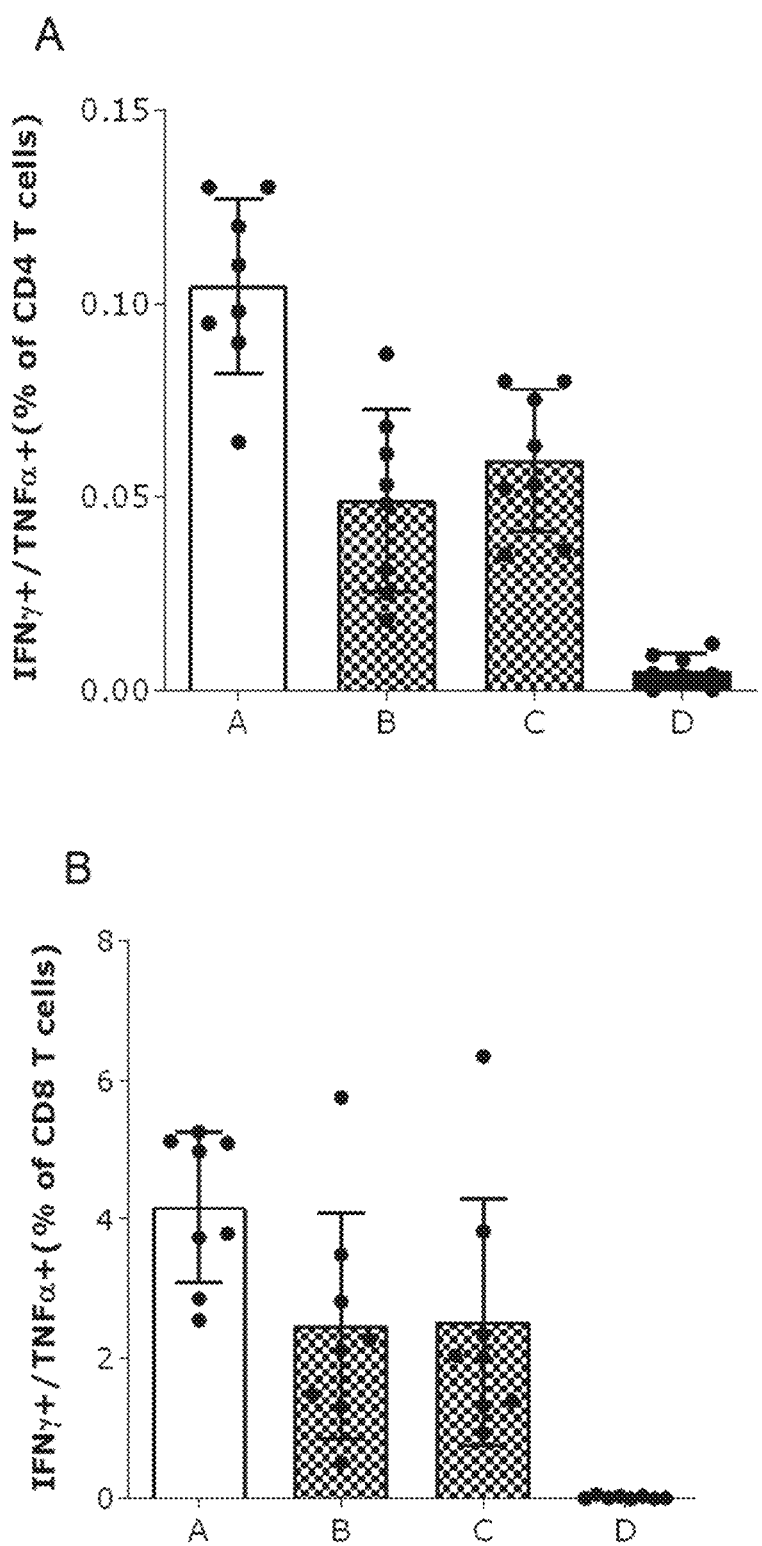

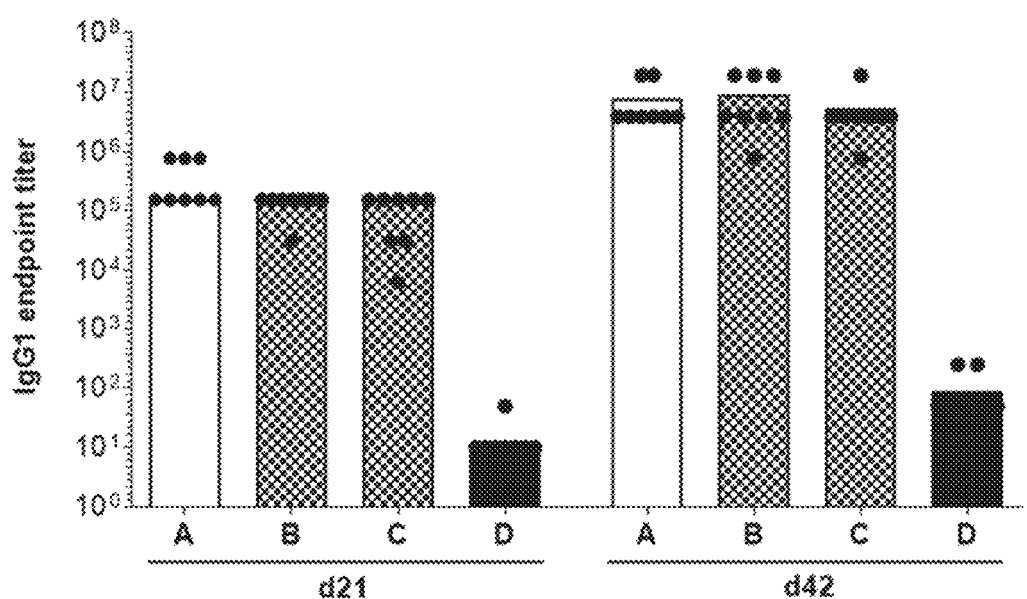
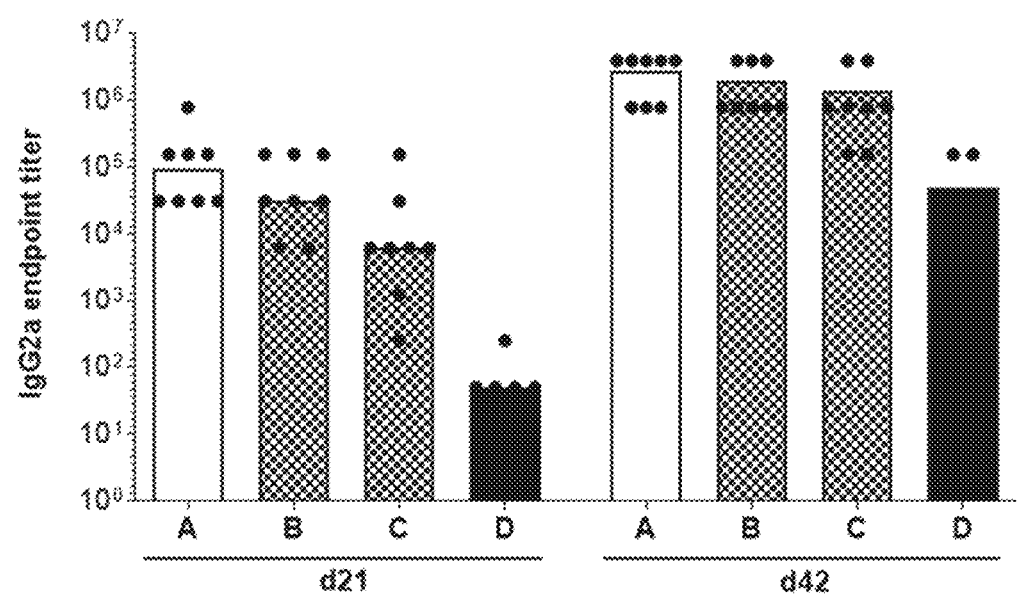
FIG. 5A-B

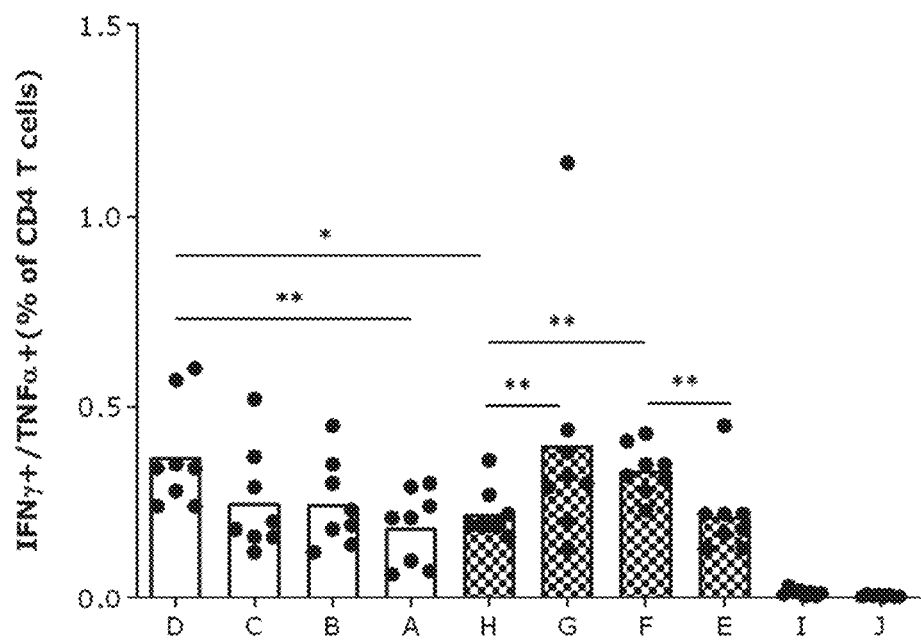
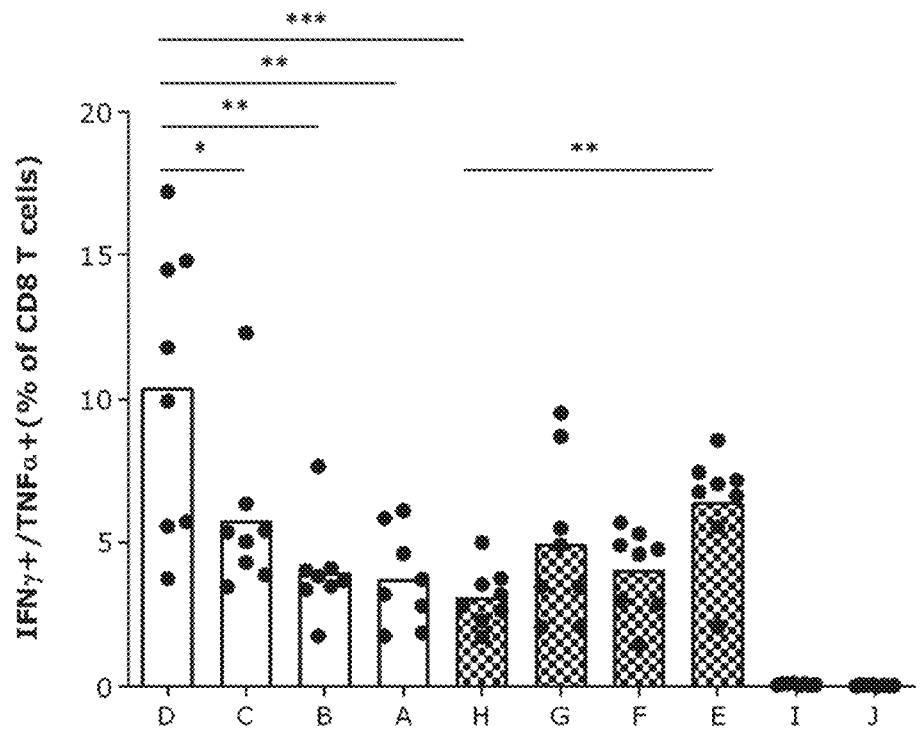
FIG. 10

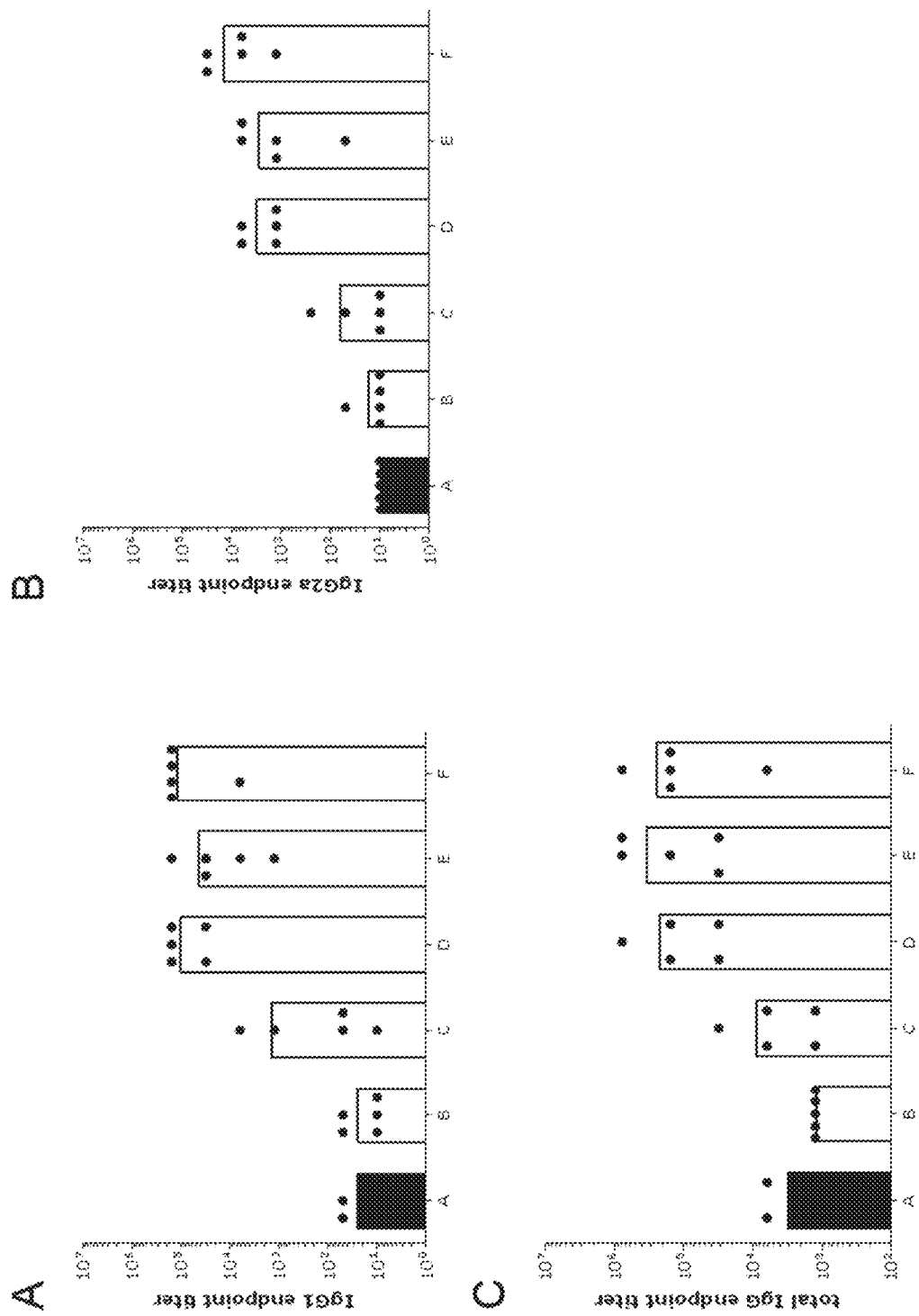
FIG. 11A-C

D
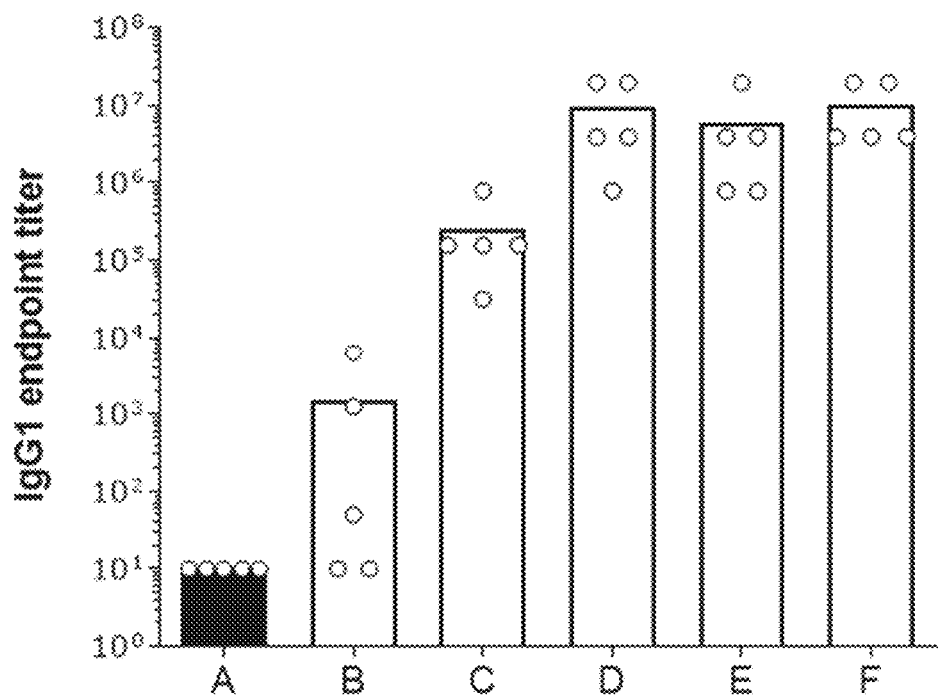
E
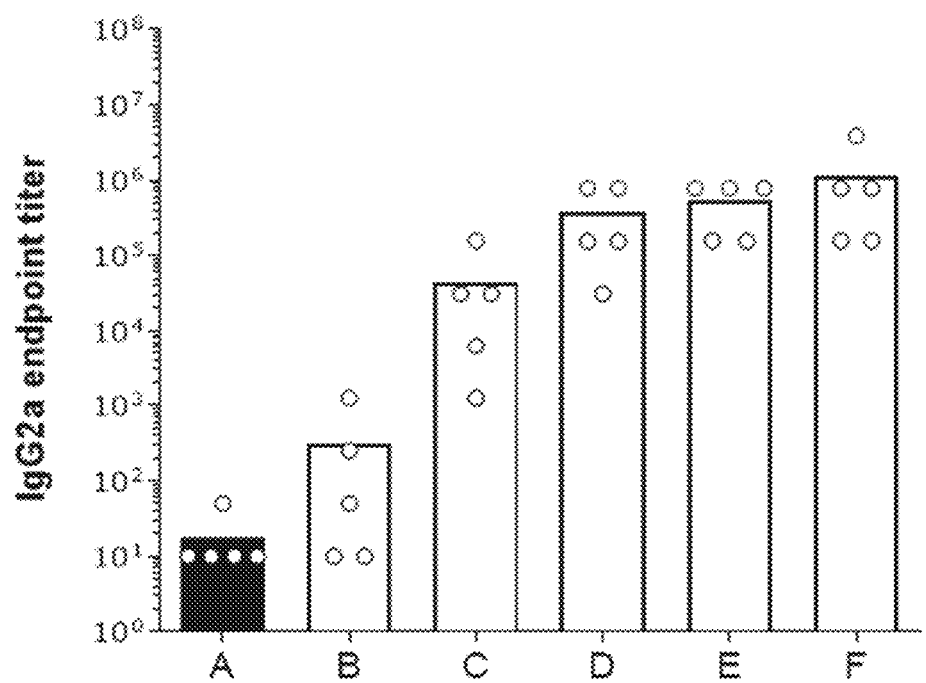
FIG. 11D-E

F
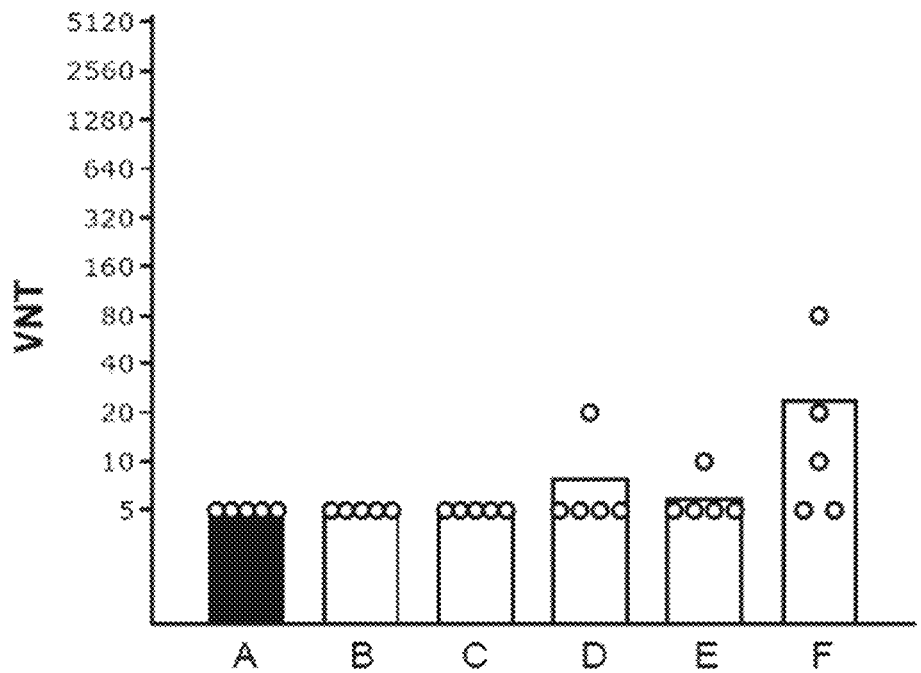
G
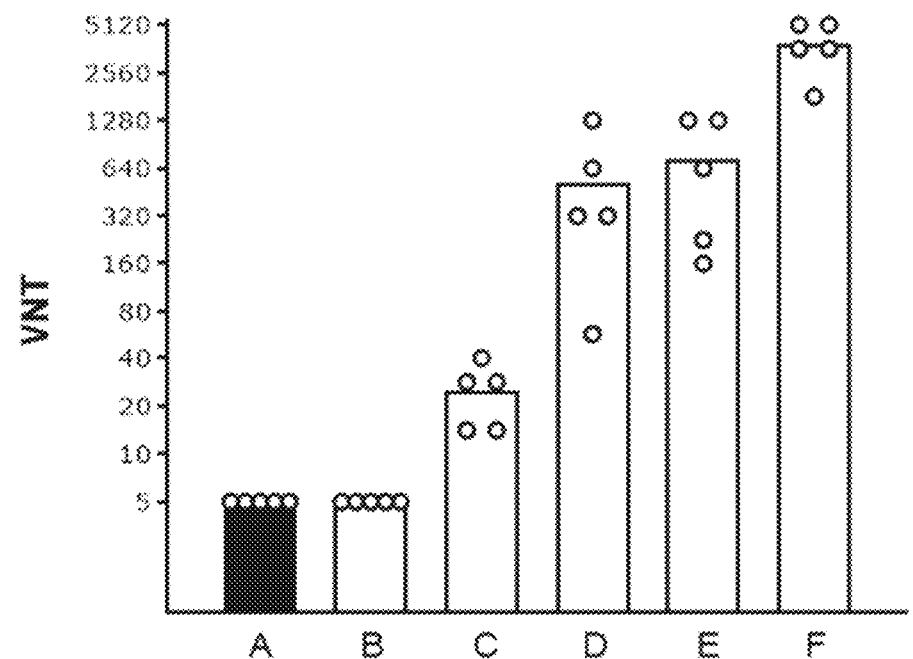
FIG. 11F-G

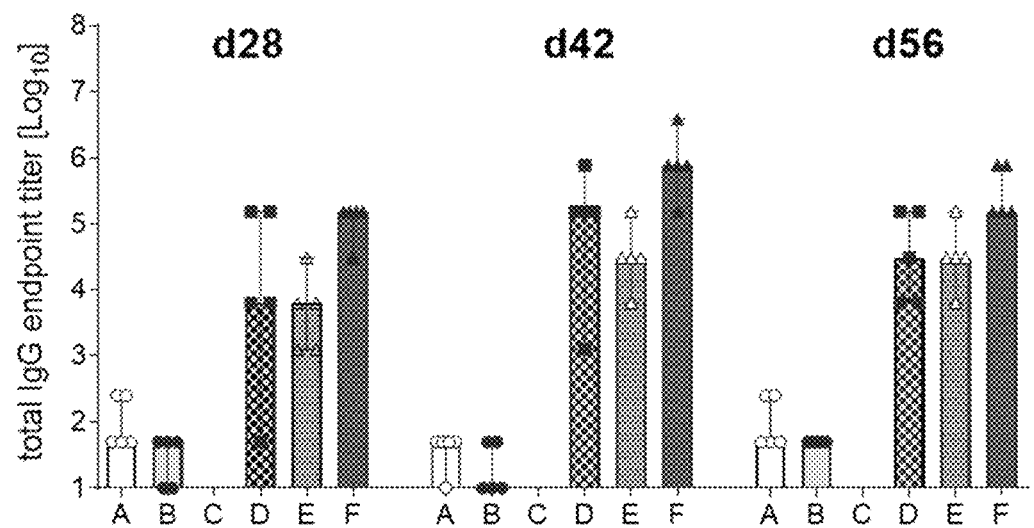
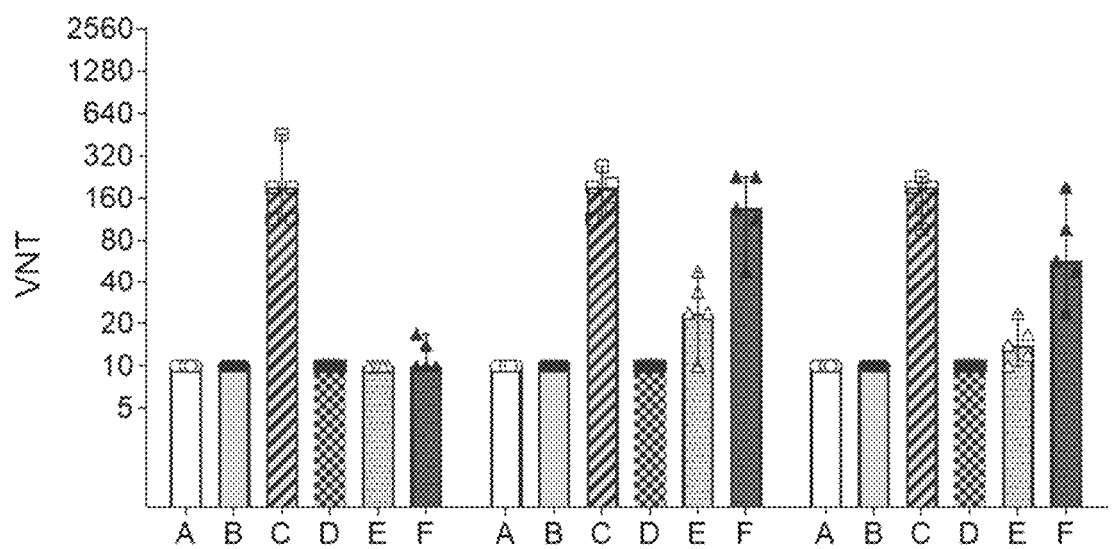
FIG. 12A-B

D
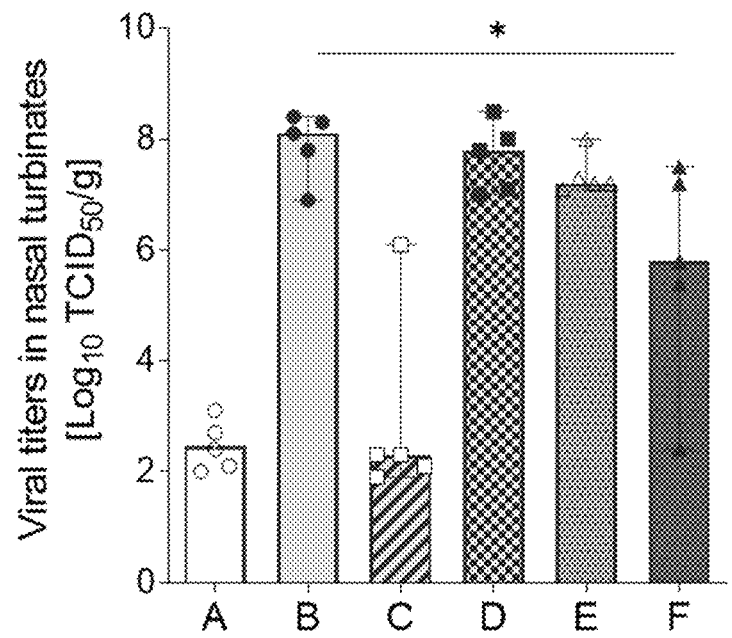
E
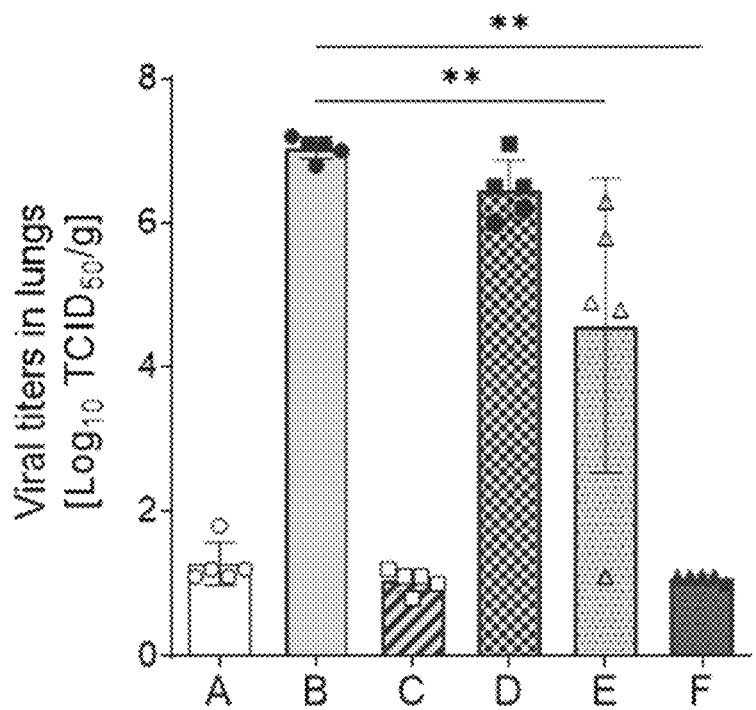
FIG. 12D-E

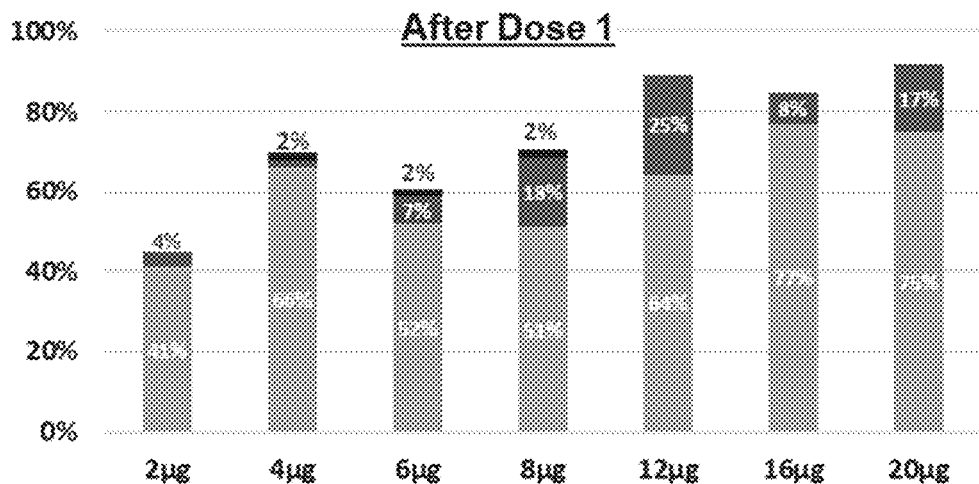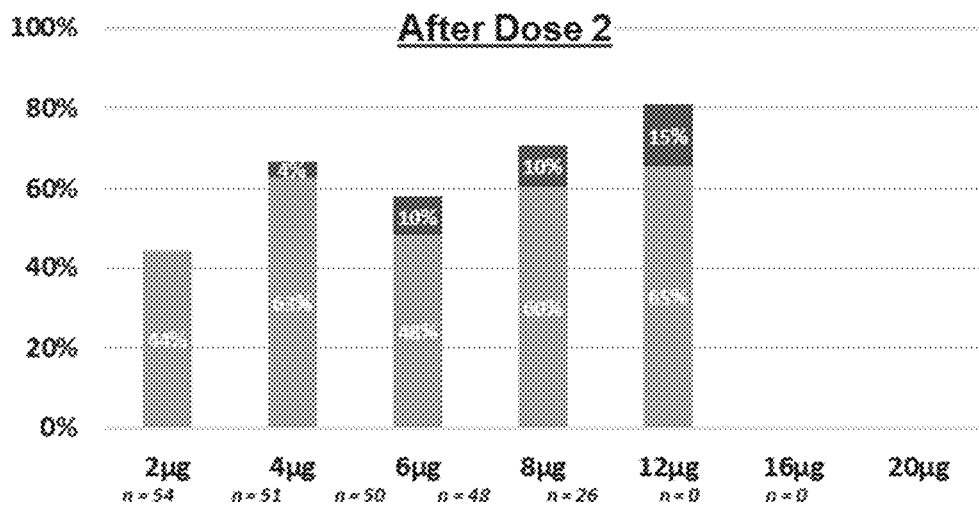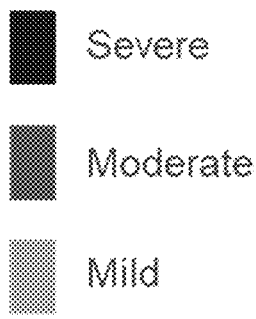
FIG. 13B

FIG. 13H

A
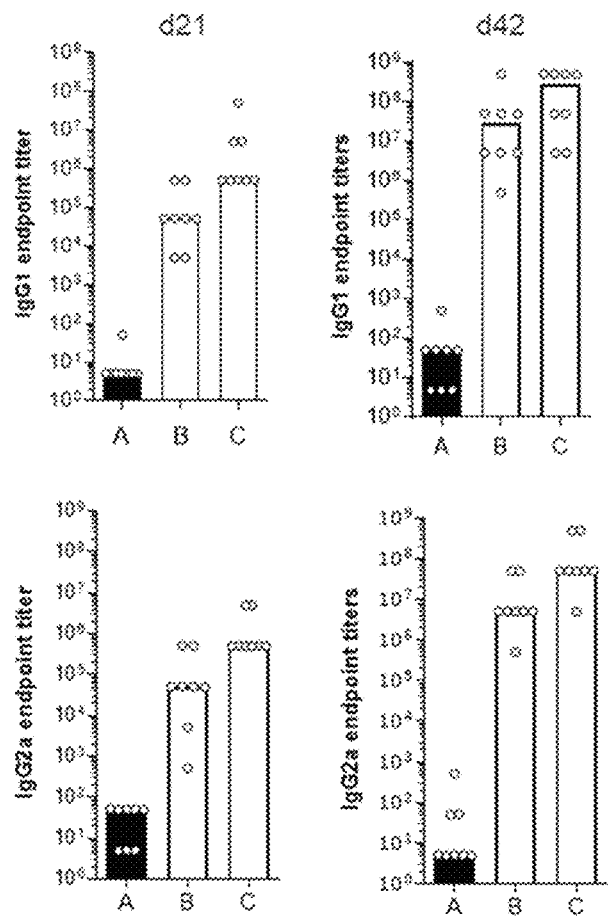
B
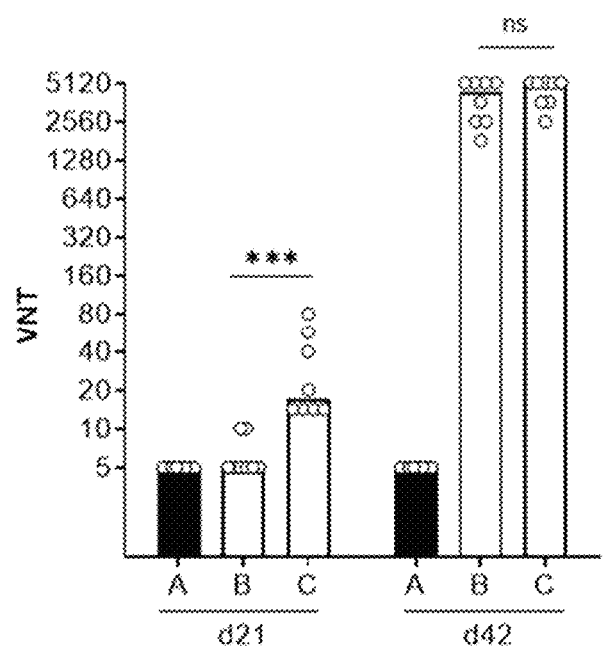
FIG. 14A-B

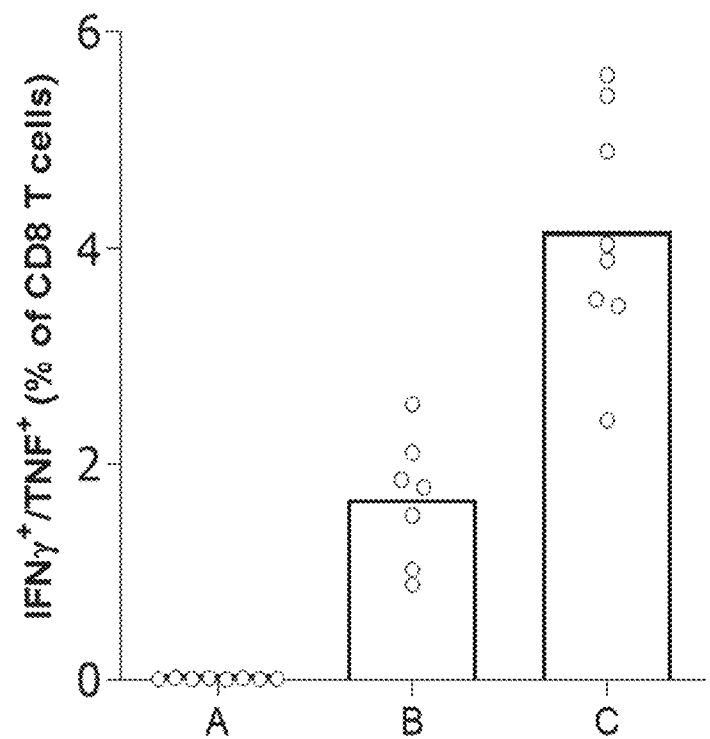
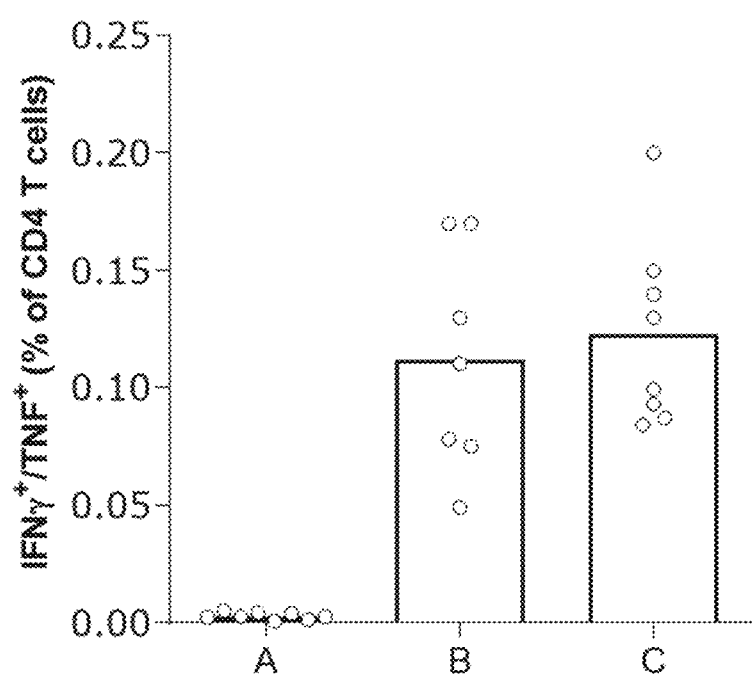
FIG. 14C

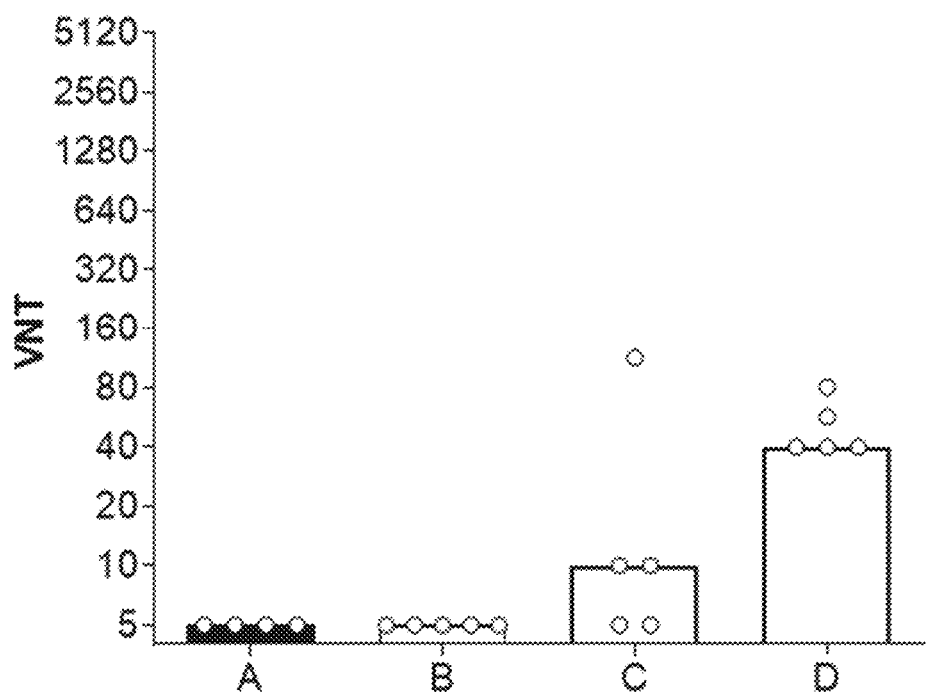
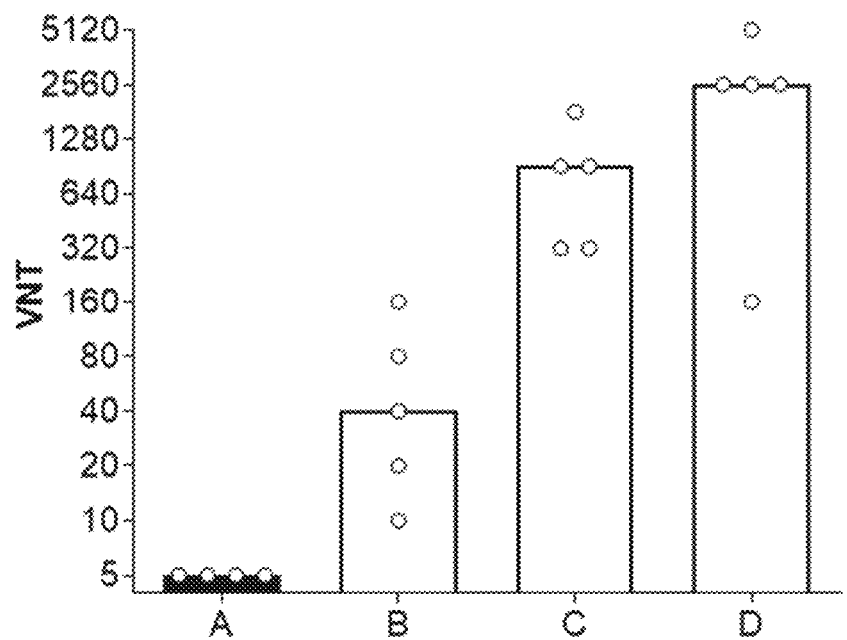
FIG. 15B

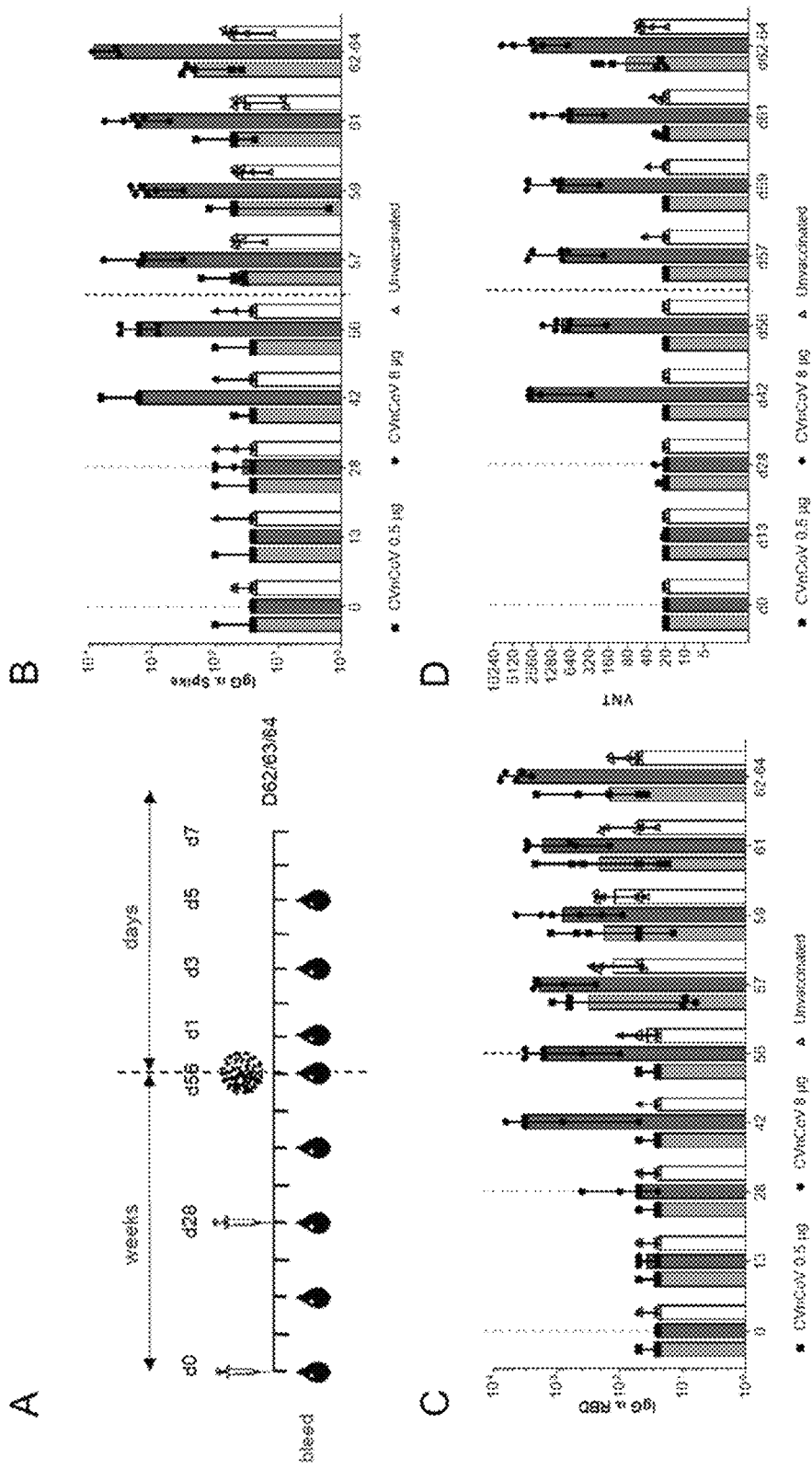
FIGS. 17A-D

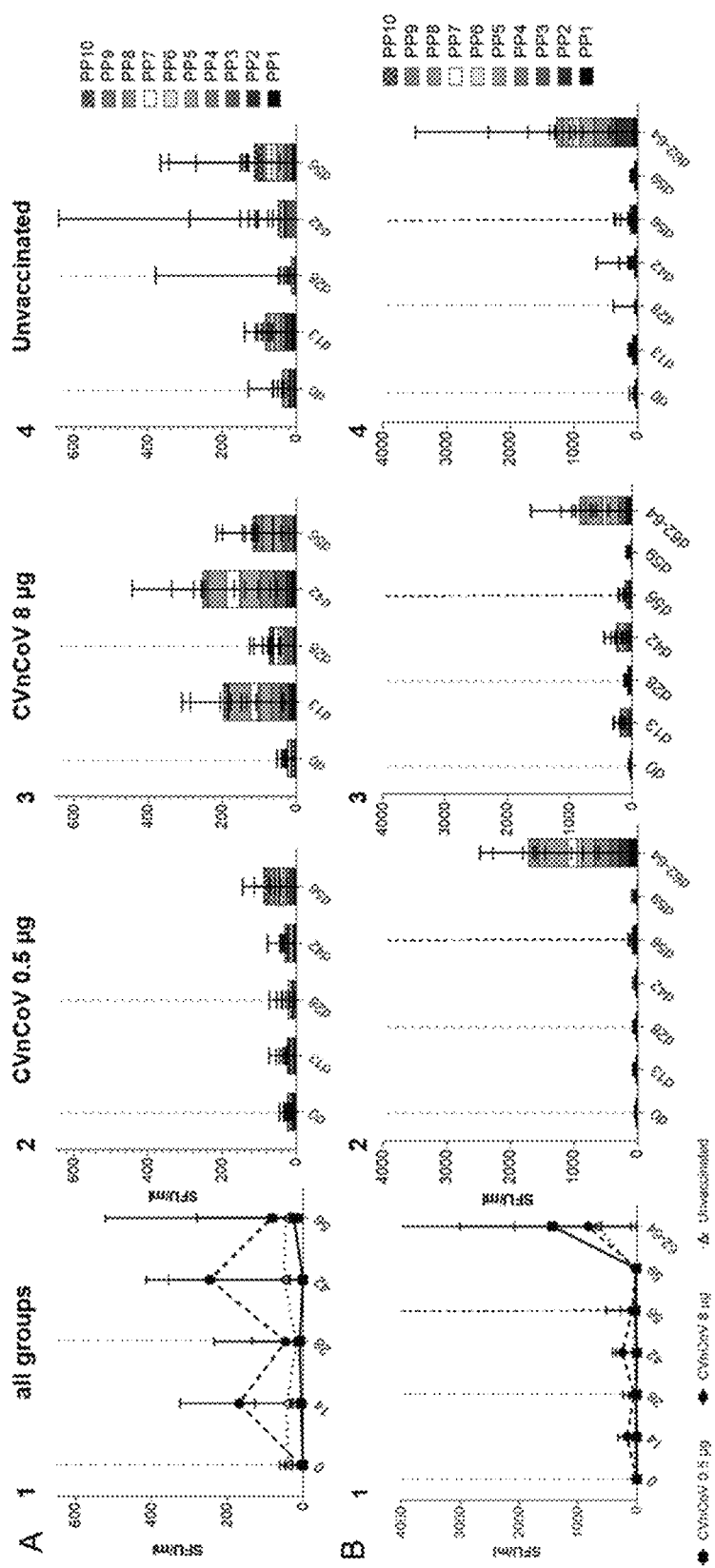
FIGS. 18A-B

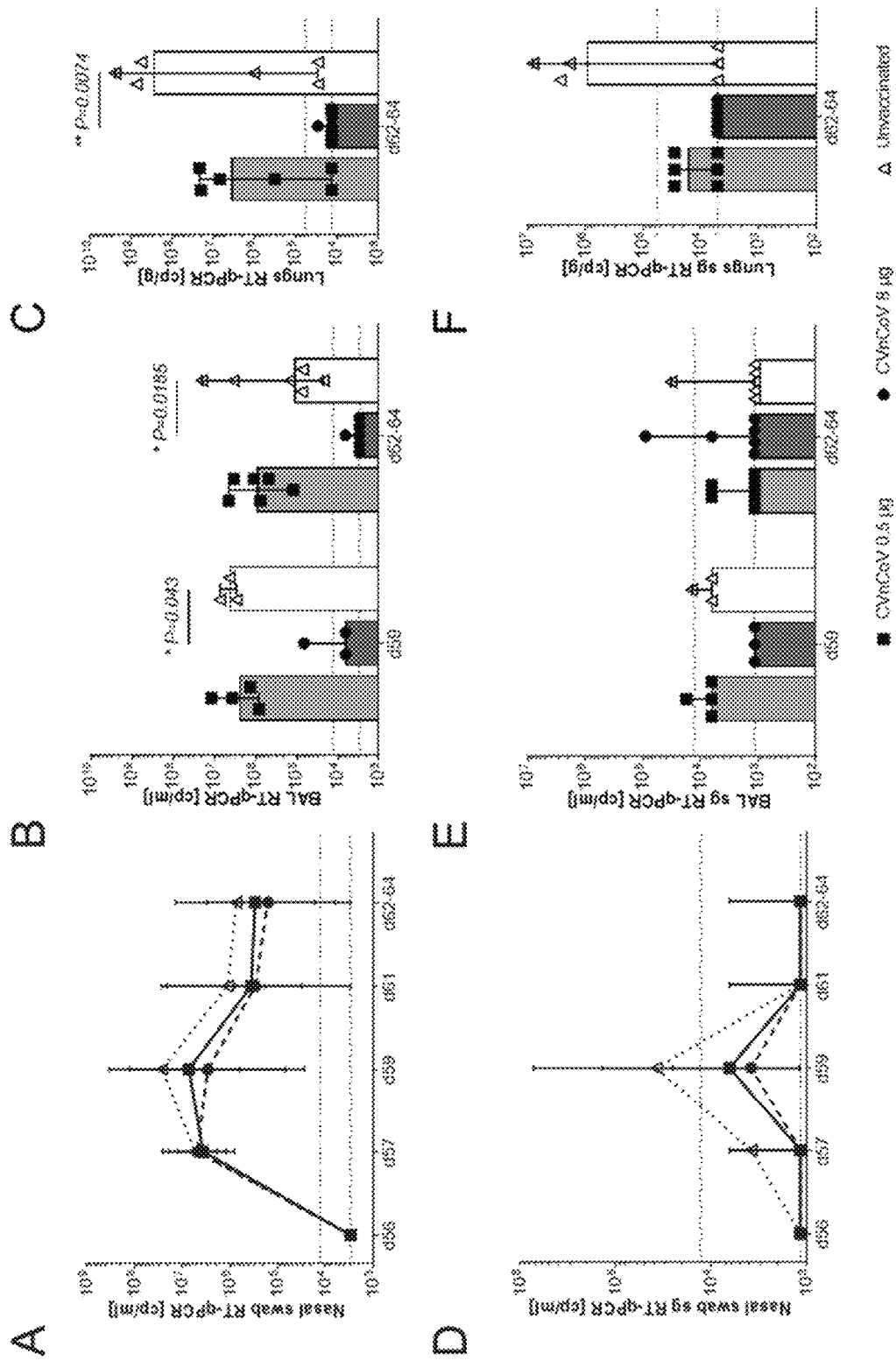
FIGS. 19A-F

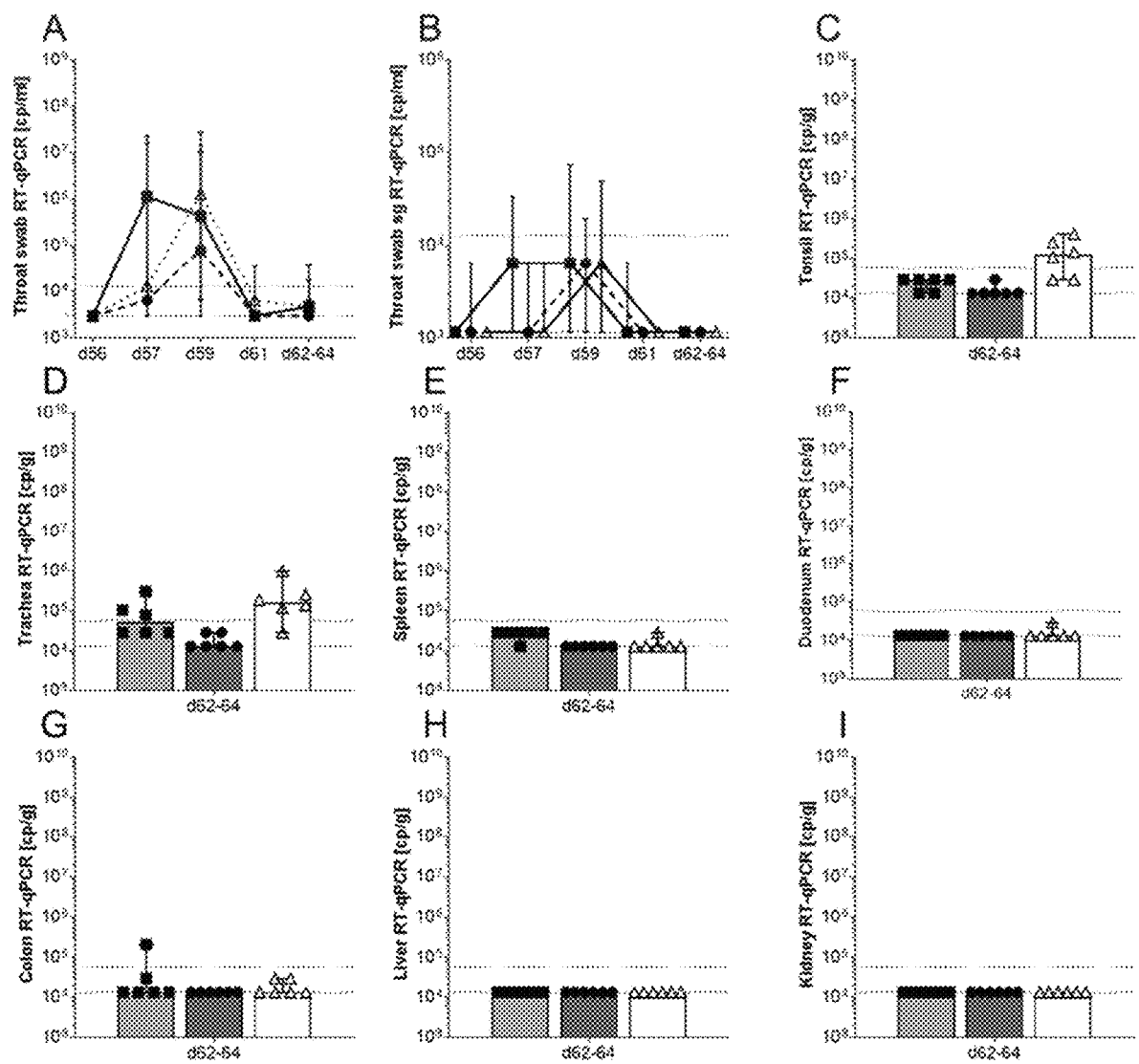
FIGS. 20A-I

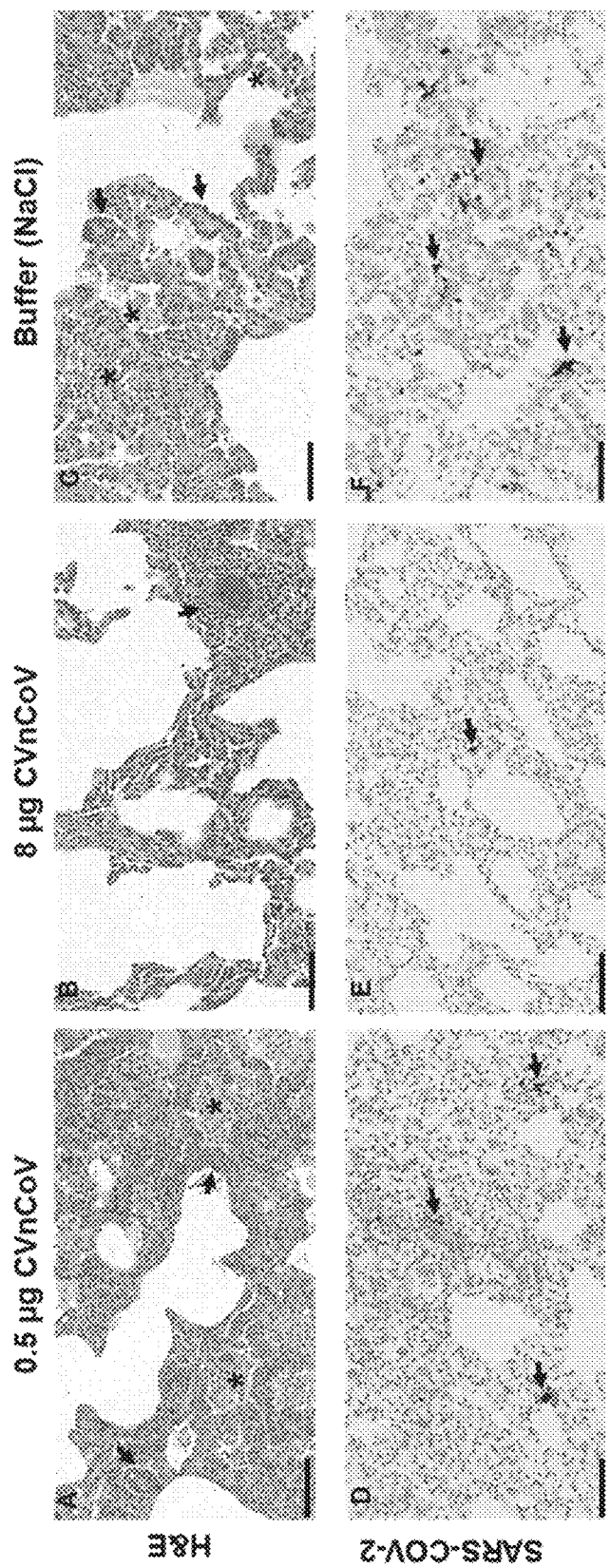
FIGS. 21A-F

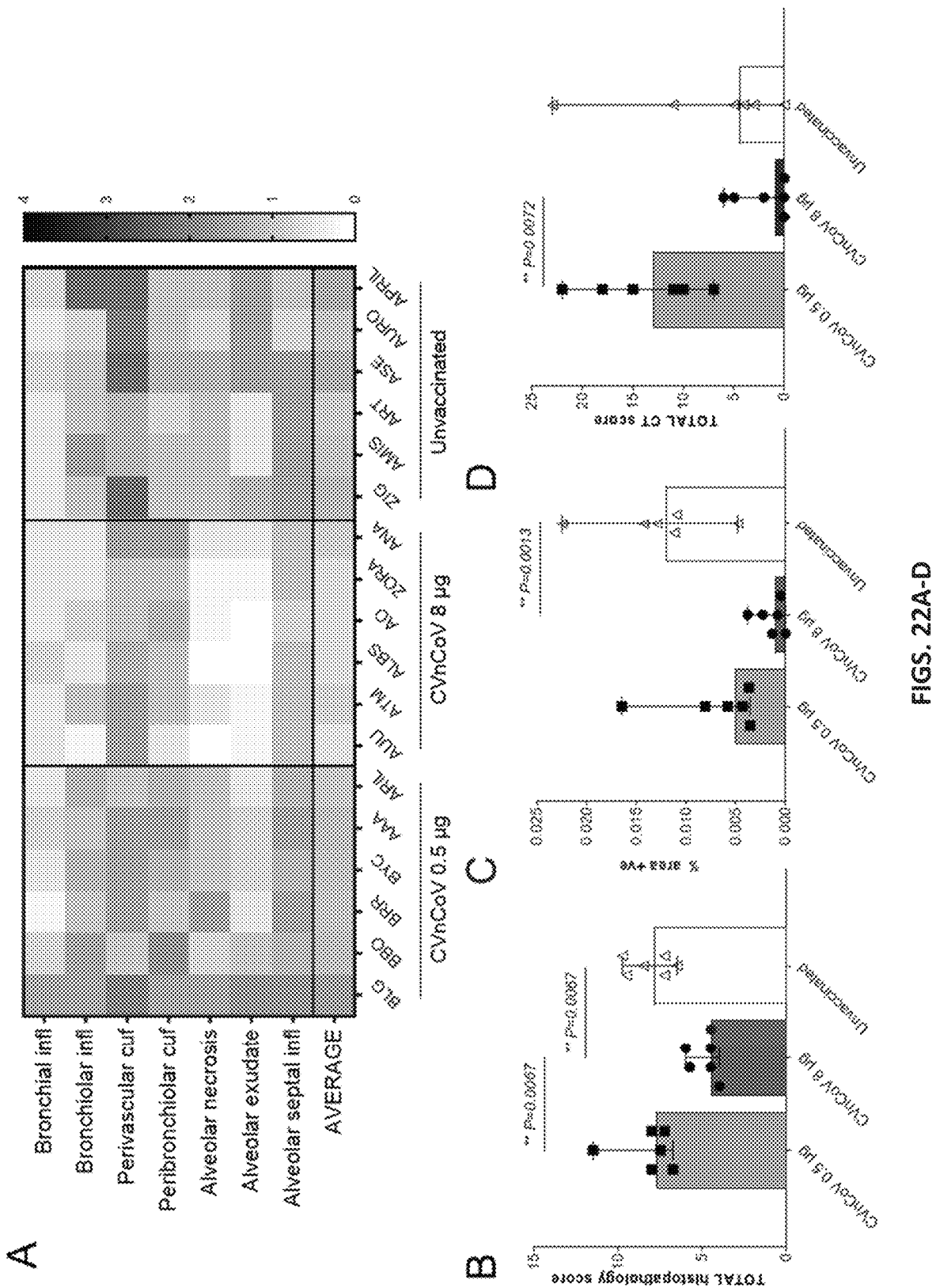
FIGS. 22A-D

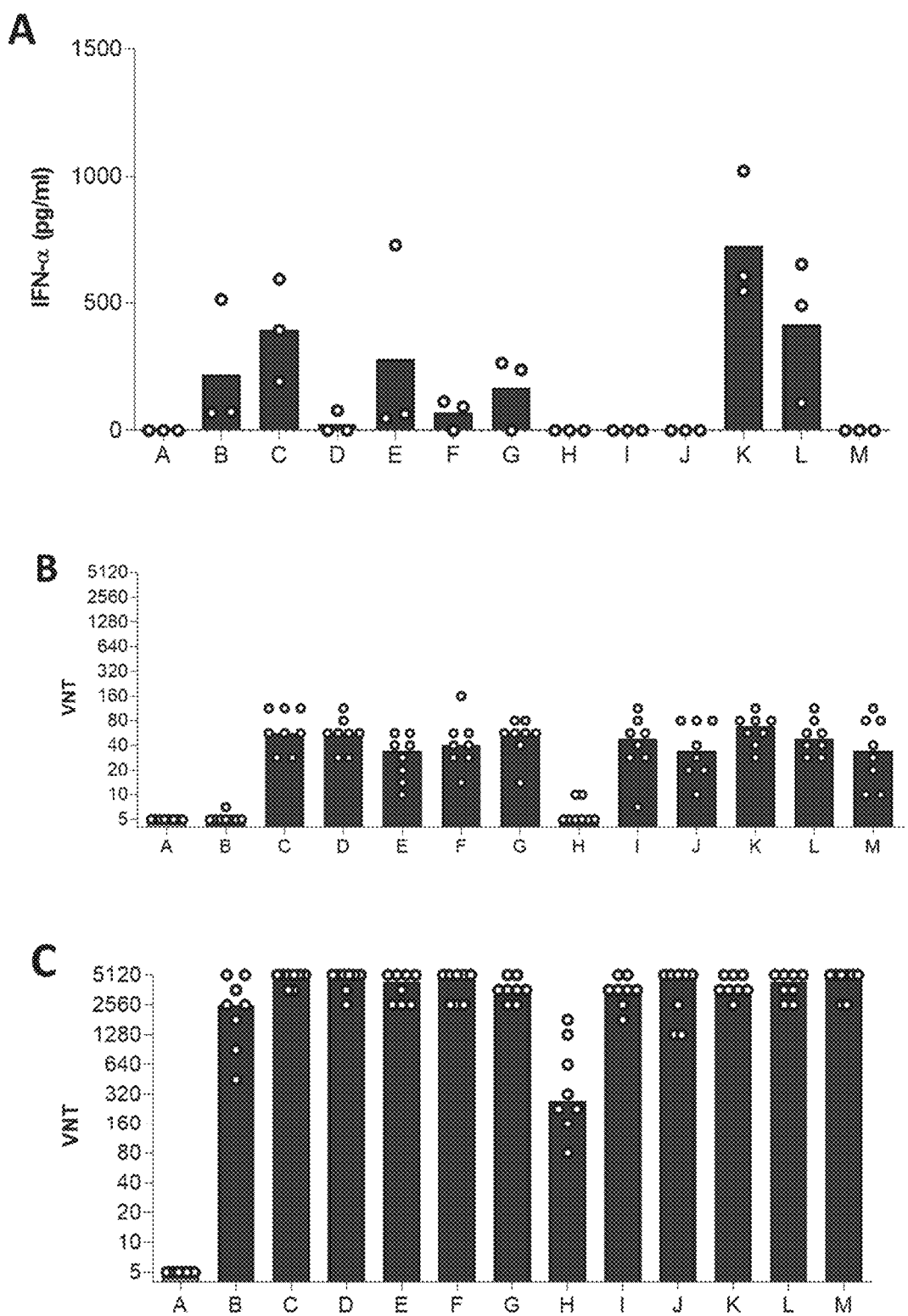
FIGS. 23A-C

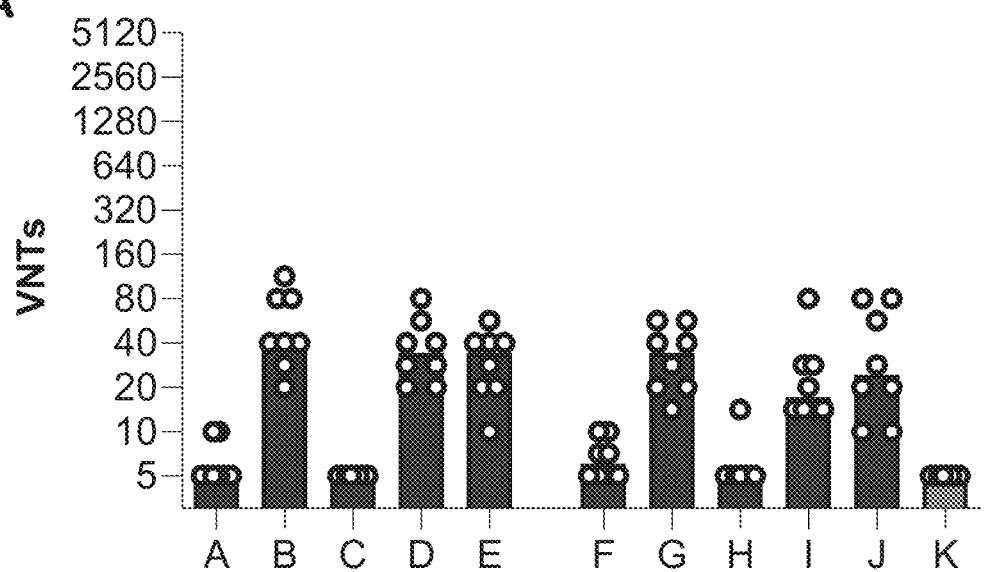
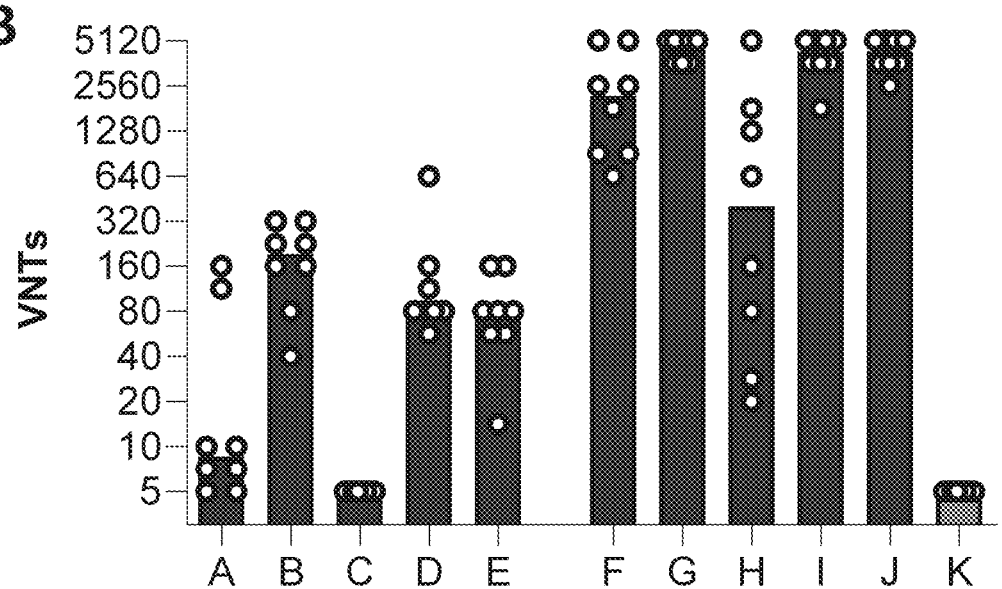
FIGS. 24A-B

CORONAVIRUS VACCINE

The present application is a continuation of U.S. application Ser. No. 17/526,912, filed Nov. 15, 2021, which is a continuation of U.S. application Ser. No. 17/276,788, filed Mar. 16, 2021, which is a national phase application under 35 U.S.C. § 371 of International Application No. PCT/EP2021/052455, filed Feb. 3, 2021, which claims priority to U.S. Provisional Application No. 63/129,395, filed Dec. 22, 2020, U.S. Provisional Application No. 63/119,390, filed Nov. 30, 2020, U.S. Provisional Application No. 63/113,159, filed Nov. 12, 2020, U.S. Provisional Application No. 63/112,106, filed Nov. 10, 2020, International Application No. PCT/EP2020/080713, filed Nov. 2, 2020, International Application No. PCT/EP2020/079973, filed Oct. 23, 2020, International Application No. PCT/EP2020/079831, filed Oct. 22, 2020, International Application No. PCT/EP2020/065091, filed May 29, 2020, International Application No. PCT/EP2020/059687, filed Apr. 3, 2020, and International Application No. PCT/EP2020/052775, filed Feb. 4, 2020, the entire contents of each of which are hereby incorporated by reference.

This application contains a Sequence Listing XML, which has been submitted electronically and is hereby incorporated by reference in its entirety. Said Sequence Listing XML, created on Aug. 8, 2022, is named CRVC.P0311USC4_ST26.xml and is 64,351,463 bytes in size.

INTRODUCTION

The present invention is inter alia directed to a nucleic acid suitable for use in treatment or prophylaxis of an infection with a coronavirus, preferably with a coronavirus SARS-CoV-2, or a disorder related to such an infection, preferably COVID-19. The present invention is also directed to compositions, polypeptides, and vaccines. The compositions and vaccines preferably comprise at least one of said nucleic acid sequences, preferably nucleic acid sequences in association with a polymeric carrier, a polycationic protein or peptide, or a lipid nanoparticle (LNP). The invention is also directed to first and second medical uses of the nucleic acid, the composition, the polypeptide, the vaccine, and the kit, and to methods of treating or preventing a coronavirus infection, preferably a SARS-CoV-2 infection.

Coronaviruses are enveloped, positive single stranded RNA viruses of the Coronaviridae family.

Their representatives cause very various diseases in different vertebrates such as mammals, birds and fish.

Coronaviruses are genetically highly variable, and individual virus species can also infect several host species by overcoming the species barrier. Such transfers have resulted in infections in humans with the SARS-associated coronavirus (SARS-CoV) and with the Middle East respiratory syndrome coronavirus (MERS-CoV). The coronavirus epidemic that started in the Chinese city of Wuhan at the turn of 2019/2020 is attributed to a previously unknown coronavirus, which was given the preliminary names nCoV-2019 or Wuhan Human Coronavirus (WHCV); later the virus was given the official name SARS-CoV-2.

Typical symptoms of a SARS-CoV-2 caused virus infection, also referred to as COVID-19 disease (Coronavirus disease 2019), include fever, cough, shortness of breath, pneumonia and gastrointestinal symptoms (e.g. diarrhoea). Severe illness can lead to respiratory failure that requires mechanical ventilation and support in an intensive care unit. On 30 Jan. 2020, the world health organization (WHO) declared a global health emergency over that novel coronavirus outbreak. On March 11, the WHO declared COVID-19 a pandemic, pointing to the over 118,000 cases of the coronavirus illness in over 110 countries and territories around the world and the sustained risk of further global spread. By end of March 2020, there were more than 800,000 confirmed cases of a SARS-CoV-2 infection, spreading across almost every country in the world, with more than 40,000 COVID-19 associated deaths.

At present, no vaccine or specific treatment is available for a SARS-CoV-2 infection and/or COVID-19 disease.

Patients diagnosed with a SARS-CoV-2 infection merely receive supportive treatment based on the individual's symptoms and clinical condition. Due to the substantial risk of a severe global pandemic, there is an urgent need for a safe and effective treatment or prophylaxis of SARS-CoV-2 infections. In particular, a vaccine is needed to protect the elderly population where high mortality rates have been observed.

Nucleic acid based vaccination, including DNA or RNA, represents a promising technique for novel vaccines against emerging viruses. Nucleic acids can be genetically engineered and administered to a human subject. Transfected cells directly produce the encoded antigen (e.g. provided by a DNA or an RNA, in particular an mRNA), which results in protective immunological responses.

A pivotal role for virus-specific memory T-cells in broad and long-term protection against SARS-CoV infection has been elucidated (see e.g. Channappanavar, Rudragouda, et al. "Virus-specific memory CD8 T cells provide substantial protection from lethal severe acute respiratory syndrome coronavirus infection." Journal of virology 88.19 (2014): 11034-11044). Virus-specific CD8 T cells are e.g. required for pathogen clearance and for mediating protection after viral challenge. An effective SARS-CoV-2 vaccine should therefore not only induce strong functional humoral immune responses, but also induce SARS-CoV-2 specific CD8+ T-cell and CD4+ T-cell responses.

Therefore, it is the object of the underlying invention to provide a nucleic acid based vaccine for coronavirus infections, in particular for SARS-CoV-2 infections. It is a further object of the present invention to provide an effective coronavirus vaccine, which can be stored and transported without cold chain and which enables rapid and scalable coronavirus vaccine production.

As further defined in the claims and the underlying description, these objects are inter alia solved by providing a nucleic acid, e.g. an RNA or a DNA, comprising at least one coding sequence encoding at least one antigenic peptide or protein derived from a coronavirus SARS-CoV-2.

Further, it would be desirable that such a nucleic acid, or e.g. a composition/vaccine comprising said nucleic acid has at least some of the following advantageous features:

Translation of the nucleic acid at the site of injection/vaccination (e.g. muscle);
Very efficient induction of antigen-specific immune responses against the encoded SARS-CoV-2 protein at a very low dosage and dosing regimen;
Suitability for vaccination of infants and/or newborns or the elderly, in particular the elderly;
Suitability of the composition/vaccine for intramuscular administration;
Induction of specific and functional humoral immune response against coronavirus, in e.g. SARS-CoV-2;
Induction of broad, functional cellular T-cell responses against coronavirus, in e.g. SARS-CoV-2;

Induction of specific B-cell memory against coronavirus, in e.g. SARS-CoV-2;

Induction of functional antibodies that can effectively neutralize the virus, e.g. SARS-CoV-2;

Induction of functional antibodies that can effectively neutralize emerging variants of SARS-CoV-2;

Eliciting of mucosal IgA immunity by inducing of mucosal IgA antibodies,

Induction of a well-balanced B cell and T cell responses;

Induction of protective immunity against coronavirus infection, e.g. against SARS-CoV-2 or emerging variants thereof;

Fast onset of immune protection against coronavirus, in e.g. SARS-CoV-2;

Longevity of the induced immune responses against coronavirus, in e.g. SARS-CoV-2;

No enhancement of a SARS-CoV-2 infection due to vaccination or immunopathological effects;

No antibody dependent enhancement (ADE) caused by the nucleic acid based SARS-CoV-2 vaccine;

No excessive induction of systemic cytokine or chemokine response after application of the vaccine, which could lead to an undesired high reactogenicity upon vaccination;

Well tolerability, no side-effects, non-toxicity of the vaccine;

Advantageous stability characteristics of the nucleic acid-based vaccine;

Speed, adaptability, simplicity and scalability of coronavirus vaccine production;

Advantageous vaccination regimen that only requires one or two vaccination for sufficient protection.

Advantageous vaccination regimen that only requires a low dose of the composition/vaccine for sufficient protection.

Definitions

For the sake of clarity and readability, the following definitions are provided. Any technical feature mentioned for these definitions may be read on each and every embodiment of the invention. Additional definitions and explanations may be specifically provided in the context of these embodiments.

Percentages in the context of numbers should be understood as relative to the total number of the respective items. In other cases, and unless the context dictates otherwise, percentages should be understood as percentages by weight (wt.-%).

About: The term "about" is used when determinants or values do not need to be identical, i.e. 100% the same. Accordingly, "about" means, that a determinant or values may diverge by 0.1% to 20%, preferably by 0.1% to 10%; in particular, by 0.5%, 1%, 2%, 3%, 4%, 5%, 6%, 7%, 8%, 9%, 10%, 11%, 12%, 13%, 14%, 15%, 16%, 17%, 18%, 19%, 20%. The skilled person will know that e.g. certain parameters or determinants may slightly vary based on the method how the parameter was determined. For example, if a certain determinants or value is defined herein to have e.g. a length of "about 1000 nucleotides", the length may diverge by 0.1% to 20%, preferably by 0.1% to 10%; in particular, by 0.5%, 1%, 2%, 3%, 4%, 5%, 6%, 7%, 8%, 9%, 10%, 11%, 12%, 13%, 14%, 15%, 16%, 17%, 18%, 19%, 20%. Accordingly, the skilled person will know that in that specific example, the length may diverge by 1 to 200 nucleotides, preferably by 1 to 200 nucleotides; in particular, by 5, 10, 20, 30, 40, 50, 60, 70, 80, 90, 100, 110, 120, 130, 140, 150, 160, 170, 180, 190, 200 nucleotides.

Adaptive immune response: The term "adaptive immune response" as used herein will be recognized and understood by the person of ordinary skill in the art, and is e.g. intended to refer to an antigen-specific response of the immune system (the adaptive immune system). Antigen specificity allows for the generation of responses that are tailored to specific pathogens or pathogen-infected cells. The ability to mount these tailored responses is usually maintained in the body by "memory cells" (B-cells). In the context of the invention, the antigen is provided by the nucleic acid (e.g. an RNA or a DNA) encoding at least one antigenic peptide or protein derived from coronavirus, preferably from SARS-CoV-2 (nCoV-2019).

Antigen: The term "antigen" as used herein will be recognized and understood by the person of ordinary skill in the art, and is e.g. intended to refer to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide or protein, which may be presented by the MHC to T-cells. Also fragments, variants and derivatives of peptides or proteins derived from e.g. spike protein (S) of coronavirus, preferably from SARS-CoV-2 (nCoV-2019) comprising at least one epitope are understood as antigens in the context of the invention. In the context of the present invention, an antigen may be the product of translation of a provided nucleic acid as specified herein.

Antigenic peptide or protein: The term "antigenic peptide or protein" or "immunogenic peptide or protein" will be recognized and understood by the person of ordinary skill in the art, and is e.g. intended to refer to a peptide, protein derived from a (antigenic or immunogenic) protein which stimulates the body's adaptive immune system to provide an adaptive immune response. Therefore an antigenic/immunogenic peptide or protein comprises at least one epitope (as defined herein) or antigen (as defined herein) of the protein it is derived from (e.g., spike protein (S) of coronavirus, preferably from SARS-CoV-2 (nCoV-2019)).

Cationic: Unless a different meaning is clear from the specific context, the term "cationic" means that the respective structure bears a positive charge, either permanently or not permanently, but in response to certain conditions such as pH. Thus, the term "cationic" covers both "permanently cationic" and "cationisable".

Cationisable: The term "cationisable" as used herein means that a compound, or group or atom, is positively charged at a lower pH and uncharged at a higher pH of its environment. Also in non-aqueous environments where no pH value can be determined, a cationisable compound, group or atom is positively charged at a high hydrogen ion concentration and uncharged at a low concentration or activity of hydrogen ions. It depends on the individual properties of the cationisable or polycationisable compound, in particular the pKa of the respective cationisable group or atom, at which pH or hydrogen ion concentration it is charged or uncharged. In diluted aqueous environments, the fraction of cationisable compounds, groups or atoms bearing a positive charge may be estimated using the so-called Henderson-Hasselbalch equation, which is well-known to a person skilled in the art. E.g., in some embodiments, if a compound or moiety is cationisable, it is preferred that it is positively charged at a pH value of about 1 to 9, preferably 4 to 9, 5 to 8 or even 6 to 8, more preferably of a pH value of or below 9, of or below 8, of or below 7, most preferably at physiological pH values, e.g. about 7.3 to 7.4, i.e. under physiological conditions, particularly under physiological salt conditions of the cell in vivo. In other embodiments, it is preferred that the cationisable compound or moiety is predominantly neutral at physiological pH values, e.g. about 7.0-7.4, but becomes positively charged at lower pH values. In some embodiments, the preferred range of pKa for the cationisable compound or moiety is about 5 to about 7.

Coding sequence/coding region: The terms "coding sequence" or "coding region" and the corresponding abbreviation "cds" as used herein will be recognized and understood by the person of ordinary skill in the art, and are e.g. intended to refer to a sequence of several nucleotide triplets, which may be translated into a peptide or protein. A coding sequence in the context of the present invention may be a DNA sequence, preferably an RNA sequence, consisting of a number of nucleotides that may be divided by three, which starts with a start codon and which preferably terminates with a stop codon.

Derived from: The term "derived from" as used throughout the present specification in the context of a nucleic acid, i.e. for a nucleic acid "derived from" (another) nucleic acid, means that the nucleic acid, which is derived from (another) nucleic acid, shares e.g. at least 60%, 70%, 80%, 81%, 82%, 83%, 84%, 85%, 86%, 87%, 88%, 89%, 90%, 91%, 92%, 93%, 94%, 95%, 96%, 97%, 98%, or 99% sequence identity with the nucleic acid from which it is derived. The skilled person is aware that sequence identity is typically calculated for the same types of nucleic acids, i.e. for DNA sequences or for RNA sequences. Thus, it is understood, if a DNA is "derived from" an RNA or if an RNA is "derived from" a DNA, in a first step the RNA sequence is converted into the corresponding DNA sequence (in particular by replacing the uracils (U) by thymidines (T) throughout the sequence) or, vice versa, the DNA sequence is converted into the corresponding RNA sequence (in particular by replacing the T by U throughout the sequence). Thereafter, the sequence identity of the DNA sequences or the sequence identity of the RNA sequences is determined. Preferably, a nucleic acid "derived from" a nucleic acid also refers to nucleic acid, which is modified in comparison to the nucleic acid from which it is derived, e.g. in order to increase RNA stability even further and/or to prolong and/or increase protein production. In the context of amino acid sequences (e.g. antigenic peptides or proteins) the term "derived from" means that the amino acid sequence, which is derived from (another) amino acid sequence, shares e.g. at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% sequence identity with the amino acid sequence from which it is derived.

Epitope: The term "epitope" (also called "antigen determinant" in the art) as used herein will be recognized and understood by the person of ordinary skill in the art, and is e.g. intended to refer to T cell epitopes and B cell epitopes. T cell epitopes or parts of the antigenic peptides or proteins and may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 to about 20 or even more amino acids. These fragments are typically recognized by T cells in form of a complex consisting of the peptide fragment and an MHC molecule, i.e. the fragments are typically not recognized in their native form. B cell epitopes are typically fragments located on the outer surface of (native) protein or peptide antigens, preferably having 5 to 15 amino acids, more preferably having 5 to 12 amino acids, even more preferably having 6 to 9 amino acids, which may be recognized by antibodies, i.e. in their native form. Such epitopes of proteins or peptides may furthermore be selected from any of the herein mentioned variants of such proteins or peptides. In this context epitopes can be conformational or discontinuous epitopes which are composed of segments of the proteins or peptides as defined herein that are discontinuous in the amino acid sequence of the proteins or peptides as defined herein but are brought together in the three-dimensional structure or continuous or linear epitopes which are composed of a single polypeptide chain.

Fragment: The term "fragment" as used throughout the present specification in the context of a nucleic acid sequence (e.g. RNA or a DNA) or an amino acid sequence may typically be a shorter portion of a full-length sequence of e.g. a nucleic acid sequence or an amino acid sequence. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 40%, 50%, 60%, 70%, 80%, 90%, 95% of the total (i.e. full-length) molecule from which the fragment is derived (e.g. spike protein (S) of coronavirus, preferably from SARS-CoV-2 (nCoV-2019)). The term "fragment" as used throughout the present specification in the context of proteins or peptides may, typically, comprise a sequence of a protein or peptide as defined herein, which is, with regard to its amino acid sequence, N-terminally and/or C-terminally truncated compared to the amino acid sequence of the original protein. Such truncation may thus occur either on the amino acid level or correspondingly on the nucleic acid level. A sequence identity with respect to such a fragment as defined herein may therefore preferably refer to the entire protein or peptide as defined herein or to the entire (coding) nucleic acid molecule of such a protein or peptide. Fragments of proteins or peptides may comprise at least one epitope of those proteins or peptides.

Heterologous: The terms "heterologous" or "heterologous sequence" as used throughout the present specification in the context of a nucleic acid sequence or an amino acid sequence refers to a sequence (e.g. RNA, DNA, amino acid) has to be understood as a sequence that is derived from another gene, another allele, or e.g. another species or virus. Two sequences are typically understood to be "heterologous" if they are not derivable from the same gene or from the same allele. I.e., although heterologous sequences may be derivable from the same organism or virus, in nature, they do not occur in the same nucleic acid or protein.

Humoral immune response: The terms "humoral immunity" or "humoral immune response" will be recognized and understood by the person of ordinary skill in the art, and are e.g. intended to refer to B-cell mediated antibody production and optionally to accessory processes accompanying antibody production. A humoral immune response may be typically characterized, e.g. by Th2 activation and cytokine production, germinal center formation and isotype switching, affinity maturation and memory cell generation. Humoral immunity may also refer to the effector functions of antibodies, which include pathogen and toxin neutralization, classical complement activation, and opsonin promotion of phagocytosis and pathogen elimination.

Identity (of a sequence): The term "identity" as used throughout the present specification in the context of a nucleic acid sequence or an amino acid sequence will be recognized and understood by the person of ordinary skill in the art, and is e.g. intended to refer to the percentage to which two sequences are identical. To determine the percentage to which two sequences are identical, e.g. nucleic acid sequences or amino acid (aa) sequences as defined herein, preferably the aa sequences encoded by the nucleic acid sequence as defined herein or the aa sequences themselves, the sequences can be aligned in order to be subsequently compared to one another. Therefore, e.g. a position of a first sequence may be compared with the corresponding position of the second sequence. If a position in the first sequence is occupied by the same residue as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using an algorithm, e.g. an algorithm integrated in the BLAST program.

Immunogen, immunogenic: The terms "immunogen" or "immunogenic" will be recognized and understood by the person of ordinary skill in the art, and are e.g. intended to refer to a compound that is able to stimulate/induce an immune response. Preferably, an immunogen is a peptide, polypeptide, or protein. An immunogen in the sense of the present invention is the product of translation of a provided nucleic acid, comprising at least one coding sequence encoding at least one antigenic peptide, protein derived from spike protein (S) of SARS-CoV-2 (nCoV-2019) as defined herein. Typically, an immunogen elicits an adaptive immune response.

Immune response: The term "immune response" will be recognized and understood by the person of ordinary skill in the art, and is e.g. intended to refer to a specific reaction of the adaptive immune system to a particular antigen (so called specific or adaptive immune response) or an unspecific reaction of the innate immune system (so called unspecific or innate immune response), or a combination thereof.

Immune system: The term "immune system" will be recognized and understood by the person of ordinary skill in the art, and is e.g. intended to refer to a system of the organism that may protect the organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Innate immune system: The term "innate immune system" (also known as non-specific or unspecific immune system) will be recognized and understood by the person of ordinary skill in the art, and is e.g. intended to refer to a system typically comprising the cells and mechanisms that defend the host from infection by other organisms in a non-specific manner. This means that the cells of the innate system may recognize and respond to pathogens in a generic way, but unlike the adaptive immune system, it does not confer long-lasting or protective immunity to the host. The innate immune system may be activated by ligands of pattern recognition receptor e.g. Toll-like receptors, NOD-like receptors, or RIG-I like receptors etc.

Lipidoid compound: A lipidoid compound, also simply referred to as lipidoid, is a lipid-like compound, i.e. an amphiphilic compound with lipid-like physical properties. In the context of the present invention, the term lipid is considered to encompass lipidoid compounds.

Permanently cationic: The term "permanently cationic" as used herein will be recognized and understood by the person of ordinary skill in the art, and means, e.g., that the respective compound, or group, or atom, is positively charged at any pH value or hydrogen ion activity of its environment. Typically, the positive charge results from the presence of a quaternary nitrogen atom. Where a compound carries a plurality of such positive charges, it may be referred to as permanently polycationic.

Stabilized RNA: The term "stabilized RNA" refer to an RNA that is modified such, that it is more stable to disintegration or degradation, e.g., by environmental factors or enzymatic digest, such as by exo- or endonuclease degradation, compared to an RNA without such modification. Preferably, a stabilized RNA in the context of the present invention is stabilized in a cell, such as a prokaryotic or eukaryotic cell, preferably in a mammalian cell, such as a human cell. The stabilization effect may also be exerted outside of cells, e.g. in a buffer solution etc., e.g., for storage of a composition comprising the stabilized RNA.

T-cell responses: The terms "cellular immunity" or "cellular immune response" or "cellular T-cell responses" as used herein will be recognized and understood by the person of ordinary skill in the art, and are for example intended to refer to the activation of macrophages, natural killer cells (NK), antigen-specific cytotoxic T-lymphocytes, and the release of various cytokines in response to an antigen. In more general terms, cellular immunity is not based on antibodies, but on the activation of cells of the immune system. Typically, a cellular immune response may be characterized e.g. by activating antigen-specific cytotoxic T-lymphocytes that are able to induce apoptosis in cells, e.g. specific immune cells like dendritic cells or other cells, displaying epitopes of foreign antigens on their surface.

Variant (of a sequence): The term "variant" as used throughout the present specification in the context of a nucleic acid sequence will be recognized and understood by the person of ordinary skill in the art, and is e.g. intended to refer to a variant of a nucleic acid sequence derived from another nucleic acid sequence. E.g., a variant of a nucleic acid sequence may exhibit one or more nucleotide deletions, insertions, additions and/or substitutions compared to the nucleic acid sequence from which the variant is derived. A variant of a nucleic acid sequence may at least 50%, 60%, 70%, 80%, 90%, or 95% identical to the nucleic acid sequence the variant is derived from. The variant is a functional variant in the sense that the variant has retained at least 50%, 60%, 70%, 80%, 90%, or 95% or more of the function of the sequence where it is derived from. A "variant" of a nucleic acid sequence may have at least 70%, 75%, 80%, 85%, 90%, 95%, 98% or 99% nucleotide identity over a stretch of at least 10, 20, 30, 50, 75 or 100 nucleotide of such nucleic acid sequence.

The term "variant" as used throughout the present specification in the context of proteins or peptides is e.g. intended to refer to a proteins or peptide variant having an amino acid sequence which differs from the original sequence in one or more mutation(s)/substitution(s), such as one or more substituted, inserted and/or deleted amino acid(s). Preferably, these fragments and/or variants have the same, or a comparable specific antigenic property (immunogenic variants, antigenic variants). Insertions and substitutions are possible, in particular, at those sequence positions which cause no modification to the three-dimensional structure or do not affect the binding region. Modifications to a three-dimensional structure by insertion(s) or deletion(s) can easily be determined e.g. using CD spectra (circular dichroism spectra). A "variant" of a protein or peptide may have at least 70%, 75%, 80%, 85%, 90%, 95%, 98% or 99% amino acid identity over a stretch of at least 10, 20, 30, 50, 75 or 100 amino acids of such protein or peptide. Preferably, a variant of a protein comprises a functional variant of the protein, which means, in the context of the invention, that the variant exerts essentially the same, or at least 40%, 50%, 60%, 70%, 80%, 90% of the immunogenicity as the protein it is derived from.

Short Description of the Invention

The present invention is based on the inventor's surprising finding that at least one peptide or protein derived from coronavirus SARS-CoV-2 (formerly called nCoV-2019), provided by the coding sequence of a nucleic acid, e.g. an RNA, can efficiently be expressed in human cells (Examples 2a, 2b, and 2c). Even more surprising and unexpected, the administration of a composition comprising said nucleic acid, e.g. said RNA, induces antigen-specific immune responses against coronavirus, in particular against coronavirus SARS-CoV-2 (see Example section). Even more unexpected, the inventors showed that the coding RNA of the invention induces high levels of functional antibodies, shown by high virus neutralizing titers (VNTs) and T-cell responses (vaccines induce double positive CD4+ and CD8+ T-cells (see e.g. Example 7 and Example 10), and even protects hamsters and NHPs from SARS-CoV-2 challenge infection (see Example 9 and Example 15), indicating that the coding RNA or the composition/vaccine of the invention is therefore suitable for use as a vaccine, e.g. as a vaccine in human subjects.

Those findings are the basis for the provision of a nucleic acid based coronavirus vaccine.

In a first aspect, the present invention provides a nucleic acid for a coronavirus vaccine, preferably a coronavirus SARS-CoV-2 vaccine, wherein said nucleic acid comprises at least one coding sequence encoding at least one antigenic peptide or protein of an SARS-CoV-2 coronavirus, or an immunogenic fragment or immunogenic variant thereof.

In a second aspect, the present invention provides a composition, preferably an immunogenic composition comprising at least one nucleic acid of the first aspect. Suitably, the composition may comprise at least one nucleic acid, e.g. at least one coding RNA, complexed with, encapsulated in, or associated with one or more lipids, thereby forming lipid nanoparticles.

In a third aspect, the present invention provides antigenic polypeptides for a coronavirus vaccine, preferably for an SARS-CoV-2 composition or vaccine.

In a fourth aspect, the present invention provides a coronavirus vaccine, preferably an SARS-CoV-2 vaccine, wherein the vaccine comprises at least one nucleic acid of the first aspect, or the composition of the second aspect, or at least one polypeptide of the third aspect.

In a fifth aspect, the present invention provides a kit or kit of parts comprising at least one nucleic acid of the first aspect, and/or at least one composition of the second aspect, and/or at least one polypeptide of the third aspect, and/or at least one vaccine of the forth aspect.

In a sixth aspect, the present invention provides a combination comprising at least two separate components, wherein the at least at least two separate components are selected from two nucleic acids of the first aspect, and/or at least two compositions of the second aspect, and/or at least two polypeptides of the third aspect, and/or at least two vaccine of the forth aspect.

Further aspects of the invention concern a method of treating or preventing coronavirus infection, preferably an SARS-CoV-2 infection in a subject, and first and second medical uses of nucleic acid, compositions, and vaccines. Also provided are methods of manufacturing the nucleic acid, the composition, or the vaccine.

DETAILED DESCRIPTION OF THE INVENTION

The present application is filed together with a sequence listing in electronic format, which is part of the description of the present application (WIPO standard ST. 25). The information contained in the sequence listing is incorporated herein by reference in its entirety. Where reference is made herein to a "SEQ ID NO", the corresponding nucleic acid sequence or amino acid (aa) sequence in the sequence listing having the respective identifier is referred to. For many sequences, the sequence listing also provides additional detailed information, e.g. regarding certain structural features, sequence optimizations, GenBank (NCBI) or GISAID (epi) identifiers, or additional detailed information regarding its coding capacity. In particular, such information is provided under numeric identifier <223> in the WIPO standard ST. 25 sequence listing. Accordingly, information provided under said numeric identifier <223> is explicitly included herein in its entirety and has to be understood as integral part of the description of the underlying invention.

Nucleic Acid for a Coronavirus Vaccine:

In a first aspect, the invention relates to a nucleic acid suitable for a coronavirus vaccine.

It has to be noted that specific features and embodiments that are described in the context of the first aspect of the invention, that is the nucleic acid of the invention, are likewise applicable to the second aspect (composition of the invention), the third aspect (polypeptide of the invention), the forth aspect (vaccine of the invention), the fifth aspect (kit or kit of parts of the invention), or further aspects including medical uses and method of treatments.

Coronaviruses can be classified into the genus Alphacoronavirus, Betacoronavirus, Deltacoronavirus, Gammacoronavirus, and unclassified Coronaviruses. Coronaviruses are genetically highly variable, and individual virus species can also infect several host species by overcoming the species barrier. Human coronaviruses include SARS-associated coronavirus (SARS-CoV), Middle East respiratory syndrome coronavirus (MERS-CoV), and coronavirus SARS- CoV-2 (previously named "Wuhan Human coronavirus" or nCoV-2019). Accordingly, the nucleic acid may be suitable for a vaccine against a coronavirus, preferably against a coronavirus that is a human pathogen, most preferably against the novel emerging coronavirus SARS-CoV-2 (nCoV-2019).

The terms "nucleic acid" or "nucleic acid molecule" will be recognized and understood by the person of ordinary skill in the art. The term "nucleic acid" or "nucleic acid molecule" as used herein preferably refers to DNA (molecules) or RNA (molecules). It is preferably used synonymously with the term polynucleotide. Preferably, a nucleic acid or a nucleic acid molecule is a polymer comprising or consisting of nucleotide monomers, which are covalently linked to each other by phosphodiester-bonds of a sugar/phosphate-backbone. The term "nucleic acid molecule" also encompasses modified nucleic acid molecules, such as base-modified, sugar-modified or backbone-modified DNA or RNA molecules as defined herein.

The nucleic acid of the first aspect, e.g. the DNA or the RNA, may form the basis for a nucleic acid based composition or vaccine. Generally, protein-based vaccines, or live attenuated vaccines, are suboptimal for use in developing countries due to their high production costs. In addition, protein-based vaccines, or live attenuated vaccines require long development times and are not suitable for rapid responses of pandemic virus outbreaks such as the Coronavirus SARS-CoV-2 outbreak in 2019/2020. In contrast, the nucleic acid-based vaccines according to the present invention allow very fast and cost-effective production. Therefore, in comparison with known vaccines, vaccine based on the inventive nucleic acid can be produced significantly cheaper and faster, which is very advantageous particularly for use in developing countries. One further advantage of a vaccine based on the inventive nucleic acid may be its temperature-stability in comparison to protein or peptide-based vaccines. However, a vaccine based on a polypeptide is also in the scope of the underlying invention (see e.g. third aspect).

The terms "nucleic acid sequence", "DNA sequence", "RNA sequence" will be recognized and understood by the person of ordinary skill in the art, and e.g. refer to a particular and individual order of the succession of its nucleotides.

In a preferred embodiment of the first aspect, the nucleic acid comprises at least one coding sequence encoding at least one antigenic peptide or protein from a SARS-CoV-2 (nCoV-2019) coronavirus, or an immunogenic fragment or immunogenic variant thereof.

The term "antigenic peptide or protein from a SARS-CoV-2 coronavirus" has to be understood as (i) an antigen that is from a SARS-CoV-2 coronavirus which means that the amino acid sequence of the antigenic peptide or protein (or a fragment thereof) is identical to a SARS-CoV-2 coronavirus protein (or a fragment thereof), or (ii) an antigen that is derived from a SARS-CoV-2 coronavirus which means that the amino acid sequence of the antigenic peptide or protein (or a fragment thereof) is not identical to a corresponding SARS-CoV-2 coronavirus protein (or a fragment thereof).

Accordingly, in a preferred embodiment of the first aspect, the nucleic acid comprises at least one coding sequence encoding at least one antigenic peptide or protein that is or is derived from an SARS-CoV-2 (nCoV-2019) coronavirus, or an immunogenic fragment or immunogenic variant thereof.

The term "antigenic peptide or protein that is or is derived from a SARS-CoV-2 (nCoV-2019) coronavirus" has to be understood as (i) an antigen that "is from a SARS-CoV-2 coronavirus" which means that the amino acid sequence of the antigenic peptide or protein (or a fragment thereof) is identical in sequence to a SARS-CoV-2 coronavirus protein (or a fragment thereof), or (ii) an antigen that "is derived from a SARS-CoV-2 coronavirus" which means that the amino acid sequence of the antigenic peptide or protein (or a fragment thereof) is not identical to a sequence of a corresponding SARS-CoV-2 coronavirus protein (or a fragment thereof).

In preferred embodiments, the nucleic acid comprises at least one coding sequence encoding at least one antigenic peptide or protein that is or is derived from an SARS-CoV-2 (nCoV-2019) coronavirus, or an immunogenic fragment or immunogenic variant thereof, wherein the nucleic acid comprises at least one heterologous untranslated region (UTR).

The term "untranslated region" or "UTR" or "UTR element" will be recognized and understood by the person of ordinary skill in the art, and are e.g. intended to refer to a part of a nucleic acid molecule typically located 5' or 3' located of a coding sequence. An UTR is not translated into protein. An UTR may be part of a nucleic acid, e.g. a DNA or an RNA. An UTR may comprise elements for controlling gene expression, also called regulatory elements. Such regulatory elements may be, e.g., ribosomal binding sites, miRNA binding sites etc.

As used herein, the terms "Human coronavirus 2019", "Wuhan Human coronavirus" (WHCV), "nCoV-2019 coronavirus", "nCoV-2019", "Wuhan seafood market pneumonia virus", "Wuhan coronavirus", "WHCV coronavirus", "HCoV-19", "SARS2", "COVID-19 virus", "hCoV-19", "SARS-CoV-2", or "coronavirus SARS-CoV-2" may be used interchangeable throughout the present invention, relating to a new pandemic coronavirus that has been emerged in the Chinese city of Wuhan at the turn of 2019/2020, causing the disease COVID-19. According to the WHO (February 2020), the virus is officially termed "SARS-CoV-2", and the associated disease is officially termed "COVID-19".

The virus SARS-CoV-2 belongs to the Coronaviridae, in particular to Orthocoronaviruses, more specifically to the genus Betacoronavirus. Exemplary SARS-CoV-2 coronaviruses are isolates including but not limited to those provided in List A and B below.

List A: Exemplary SARS-CoV-2 Coronavirus Isolates (EPI/GISAID):

EPL_ISL_402119, EPI_ISL_402120, EPI_ISL_402121, EPI_ISL_402123, EPI_ISL_402124 (hCoV-19/Wuhan/WIV04/2019), EPI_ISL_402125, EPI EPL_ISL_402128 (hCoV-19/Wuhan/WIV05/2019; WIV05; SARS-CoV-2/Wuhan/WIV05/2019_EPL_ISL_402128), EPI_ISL_402129, EPI_ISL_402130, EPL_ISL_402131, EPL_ISL_402132, EPL_ISL_403928, EPL_ISL_403929, EPL_ISL_403930, EPI_ISL_403931, EPL_ISL_403932, EPL_ISL_403933, EPL_ISL_403934, EPL_ISL_403935, EPI_ISL_403936, EPI_ISL_403937, EPL_ISL_403962, EPL_ISL_403963, EPI_ISL_404227, EPL_ISL_404228, EPL_ISL_404253, EPI_ISL_404895, EPL_ISL_405839, EPL_ISL_406030, EPI_ISL_406031, EPL_ISL_406034, EPL_ISL_406036, EPI_ISL_406223, EPI_ISL_406531, EPL_ISL_406533, EPI_ISL_406534, EPL_ISL_406535, EPL_ISL_406536, EPI_ISL_406538, EPL_ISL_406592, EPL_ISL_406593, EPI_ISL_406594, EPL_ISL_406595, EPL_ISL_406596, EPI_ISL_406597, EPL_ISL_406798, EPL_ISL_406800, EPI_ISL_406801, EPL_ISL_406844, EPL_ISL_406862, EPI_ISL_406716, EPL_ISL_406717, EPL_ISL_406970, EPI_ISL_406973, EPL_ISL_407071, EPL_ISL_407073, EPI_ISL_407079, EPL_ISL_407084, EPI_ISL_407193, EPI_ISL_407214, EPI_ISL_407215, EPI_ISL_413761, EPI_ISL_413791, EPI_ISL_413809,
EPI_ISL_407313, EPI_ISL_407893, EPI_ISL_407894, EPI_ISL_413852, EPI_ISL_413853, EPI_ISL_413854,
EPI_ISL_407896, EPI_ISL_407976, EPI_ISL_407987, EPI_ISL_413856, EPI_ISL_413857, EPI_ISL_413858,
EPI_ISL_407988, EPI_ISL_408008, EPI_ISL_408009, EPI_ISL_413860, EPI_ISL_413861, EPI_ISL_413862,
EPI_ISL_408010, EPI_ISL_408430, EPI_ISL_408431, EPI_ISL_413863, EPI_ISL_413928, EPI_ISL_413931,
EPI_ISL_408478, EPI_ISL_408479, EPI_ISL_408480, EPI_ISL_413996, EPI_ISL_413997, EPI_ISL_413999,
EPI_ISL_408481, EPI_ISL_408482, EPI_ISL_408484, EPI_ISL_414005, EPI_ISL_414006, EPI_ISL_414007,
EPI_ISL_408486, EPI_ISL_408488, EPI_ISL_408489, EPI_ISL_414008, EPI_ISL_414009, EPI_ISL_414011,
EPI_ISL_408514, EPI_ISL_408515, EPI_ISL_408665, EPI_ISL_414012, EPI_ISL_414019, EPI_ISL_414020,
EPI_ISL_408666, EPI_ISL_408667, EPI_ISL_408668, EPI_ISL_414021, EPI_ISL_414022, EPI_ISL_414023,
EPI_ISL_408669, EPI_ISL_408670, EPI_ISL_408976, EPI_ISL_414027, EPI_ISL_414040, EPI_ISL_414041,
EPI_ISL_408977, EPI_ISL_409067, EPI_ISL_410044, EPI_ISL_414042, EPI_ISL_414043, EPI_ISL_414044,
EPI_ISL_410045, EPI_ISL_410218, EPI_ISL_410301, EPI_ISL_414045, EPI_ISL_414363, EPI_ISL_414366,
EPI_ISL_410486, EPI_ISL_410531, EPI_ISL_410532, EPI_ISL_414367, EPI_ISL_414368, EPI_ISL_414369,
EPI_ISL_410535, EPI_ISL_410536, EPI_ISL_410537, EPI_ISL_414414, EPI_ISL_414423, EPI_ISL_414428,
EPI_ISL_410538, EPI_ISL_410539, EPI_ISL_410540, EPI_ISL_414429, EPI_ISL_414433, EPI_ISL_414435,
EPI_ISL_410541, EPI_ISL_410542, EPI_ISL_410713, EPI_ISL_414439, EPI_ISL_414443, EPI_ISL_414445,
EPI_ISL_410714, EPI_ISL_410715, EPI_ISL_410716, EPI_ISL_414446, EPI_ISL_414451, EPI_ISL_414457,
EPI_ISL_410717, EPI_ISL_410718, EPI_ISL_410719, EPI_ISL_414468, EPI_ISL_414470, EPI_ISL_414476,
EPI_ISL_410720, EPI_ISL_410984, EPI_ISL_411060, EPI_ISL_414477, EPI_ISL_414479, EPI_ISL_414480,
EPI_ISL_411066, EPI_ISL_411218, EPI_ISL_411219, EPI_ISL_414481, EPI_ISL_414482, EPI_ISL_414483,
EPI_ISL_411220, EPI_ISL_411902, EPI_ISL_411915, EPI_ISL_414484, EPI_ISL_414485, EPI_ISL_414487,
EPI_ISL_411926, EPI_ISL_411927, EPI_ISL_411929, EPI_ISL_414500, EPI_ISL_414505, EPI_ISL_414509,
EPI_ISL_411950, EPI_ISL_411951, EPI_ISL_411952, EPI_ISL_414510, EPI_ISL_414511, EPI_ISL_414517,
EPI_ISL_411953, EPI_ISL_411954, EPI_ISL_411955, EPI_ISL_414519, EPI_ISL_414520, EPI_ISL_414521,
EPI_ISL_411956, EPI_ISL_411957, EPI_ISL_412026, EPI_ISL_414522, EPI_ISL_414523, EPI_ISL_414524,
EPI_ISL_412028, EPI_ISL_412029, EPI_ISL_412030, EPI_ISL_414525, EPI_ISL_414526, EPI_ISL_414527,
EPI_ISL_412459, EPI_ISL_412862, EPI_ISL_412869, EPI_ISL_414528, EPI_ISL_414529, EPI_ISL_414530,
EPI_ISL_412870, EPI_ISL_412871, EPI_ISL_412872, EPI_ISL_414531, EPI_ISL_414532, EPI_ISL_414534,
EPI_ISL_412873, EPI_ISL_412898, EPI_ISL_412899, EPI_ISL_414535, EPI_ISL_414545, EPI_ISL_414546,
EPI_ISL_412912, EPI_ISL_412966, EPI_ISL_412967, EPI_ISL_414547, EPI_ISL_414548, EPI_ISL_414549,
EPI_ISL_412968, EPI_ISL_412969, EPI_ISL_412970, EPI_ISL_414552, EPI_ISL_414554, EPI_ISL_414555,
EPI_ISL_412972, EPI_ISL_412973, EPI_ISL_412974, EPI_ISL_414556, EPI_ISL_414557, EPI_ISL_414558,
EPI_ISL_412975, EPI_ISL_412978, EPI_ISL_412979, EPI_ISL_414559, EPI_ISL_414560, EPI_ISL_414561,
EPI_ISL_412980, EPI_ISL_412981, EPI_ISL_412982, EPI_ISL_414562, EPI_ISL_414564, EPI_ISL_414565,
EPI_ISL_412983, EPI_ISL_413014, EPI_ISL_413015, EPI_ISL_414566, EPI_ISL_414569, EPI_ISL_414571,
EPI_ISL_413016, EPI_ISL_413017, EPI_ISL_413018, EPI_ISL_414574, EPI_ISL_414577, EPI_ISL_414578,
EPI_ISL_413021, EPI_ISL_413022, EPI_ISL_413023, EPI_ISL_414579, EPI_ISL_414580, EPI_ISL_414586,
EPI_ISL_413024, EPI_ISL_413213, EPI_ISL_413214, EPI_ISL_414587, EPI_ISL_414588, EPI_ISL_414589,
EPI_ISL_413455, EPI_ISL_413456, EPI_ISL_413457, EPI_ISL_414590, EPI_ISL_414591, EPI_ISL_414592,
EPI_ISL_413458, EPI_ISL_413459, EPI_ISL_413485, EPI_ISL_414593, EPI_ISL_414594, EPI_ISL_414595,
EPI_ISL_413486, EPI_ISL_413488, EPI_ISL_413489, EPI_ISL_414596, EPI_ISL_414597, EPI_ISL_414600,
EPI_ISL_413490, EPI_ISL_413513, EPI_ISL_413514, EPI_ISL_414601, EPI_ISL_414616, EPI_ISL_414617,
EPI_ISL_413515, EPI_ISL_413516, EPI_ISL_413518, EPI_ISL_414618, EPI_ISL_414619, EPI_ISL_414620,
EPI_ISL_413519, EPI_ISL_413520, EPI_ISL_413521, EPI_ISL_414621, EPI_ISL_414622, EPI_ISL_414623,
EPI_ISL_413522, EPI_ISL_413523, EPI_ISL_413555, EPI_ISL_414624, EPI_ISL_414625, EPI_ISL_414626,
EPI_ISL_413557, EPI_ISL_413558, EPI_ISL_413559, EPI_ISL_414627, EPI_ISL_414628, EPI_ISL_414629,
EPI_ISL_413560, EPI_ISL_413562, EPI_ISL_413563, EPI_ISL_414630, EPI_ISL_414631, EPI_ISL_414632,
EPI_ISL_413566, EPI_ISL_413572, EPI_ISL_413573, EPI_ISL_414633, EPI_ISL_414635, EPI_ISL_414637,
EPI_ISL_413577, EPI_ISL_413579, EPI_ISL_413580, EPI_ISL_414638, EPI_ISL_414641, EPI_ISL_414642,
EPI_ISL_413581, EPI_ISL_413582, EPI_ISL_413583, EPI_ISL_414643, EPI_ISL_414646, EPI_ISL_414648,
EPI_ISL_413584, EPI_ISL_413587, EPI_ISL_413589, EPI_ISL_414663, EPI_ISL_414684, EPI_ISL_414685,
EPI_ISL_413590, EPI_ISL_413591, EPI_ISL_413592, EPI_ISL_414686, EPI_ISL_414687, EPI_ISL_414688,
EPI_ISL_413593, EPI_ISL_413594, EPI_ISL_413595, EPI_ISL_414689, EPI_ISL_414690, EPI_ISL_414691,
EPI_ISL_413596, EPI_ISL_413597, EPI_ISL_413598, EPI_ISL_414692, EPI_ISL_414936, EPI_ISL_414937,
EPI_ISL_413599, EPI_ISL_413600, EPI_ISL_413602, EPI_ISL_414938, EPI_ISL_414940, EPI_ISL_414941,
EPI_ISL_413603, EPI_ISL_413604, EPI_ISL_413606, EPI_ISL_415105, EPI_ISL_415128, EPI_ISL_415129,
EPI_ISL_413607, EPI_ISL_413608, EPI_ISL_413609, EPI_ISL_415136, EPI_ISL_415141, EPI_ISL_415142,
EPI_ISL_413610, EPI_ISL_413611, EPI_ISL_413612, EPI_ISL_415147, EPI_ISL_415150, EPI_ISL_415151,
EPI_ISL_413613, EPI_ISL_413614, EPI_ISL_413615, EPI_ISL_415152, EPI_ISL_415153, EPI_ISL_415154,
EPI_ISL_413616, EPI_ISL_413617, EPI_ISL_413618, EPI_ISL_415155, EPI_ISL_415156, EPI_ISL_415157,
EPI_ISL_413619, EPI_ISL_413620, EPI_ISL_413621, EPI_ISL_415158, EPI_ISL_415159, EPI_ISL_415710,
EPI_ISL_413622, EPI_ISL_413647, EPI_ISL_413648, EPI_ISL_416426, EPI_ISL_416457, EPI_ISL_416481,
EPI_ISL_413691, EPI_ISL_413692, EPI_ISL_413693, EPI_ISL_416489, EPI_ISL_416491, EPI_ISL_416492,
EPI_ISL_413694, EPI_ISL_413697, EPI_ISL_413711, EPI_ISL_416514, EPI_ISL_416515, EPI_ISL_416516,
EPI_ISL_413729, EPI_ISL_413746, EPI_ISL_413748, EPI_ISL_416517, EPI_ISL_416518, EPI_ISL_416538,
EPI_ISL_413749, EPI_ISL_413750, EPI_ISL_413751, EPI_ISL_416539, EPI_ISL_416683, EPI_ISL_416685, EPI_ISL_416704, EPI_ISL_416711, EPI_ISL_416713, EPI_ISL_417706, EPI_ISL_417709, EPI_ISL_417712,
EPI_ISL_416715, EPI_ISL_416717, EPI_ISL_416744, EPI_ISL_417716, EPI_ISL_417717, EPI_ISL_417724,
EPI_ISL_416830, EPI_ISL_416831, EPI_ISL_416832, EPI_ISL_417733, EPI_ISL_417737, EPI_ISL_417740,
EPI_ISL_417020, EPI_ISL_417021, EPI_ISL_417022, EPI_ISL_417742, EPI_ISL_417743, EPI_ISL_417746,
EPI_ISL_417023, EPI_ISL_417024, EPI_ISL_417025, EPI_ISL_417750, EPI_ISL_417752, EPI_ISL_417753,
EPI_ISL_417026, EPI_ISL_417027, EPI_ISL_417028, EPI_ISL_417754, EPI_ISL_417762, EPI_ISL_417763,
EPI_ISL_417034, EPI_ISL_417200, EPI_ISL_417201, EPI_ISL_417764, EPI_ISL_417766, EPI_ISL_417774,
EPI_ISL_417202, EPI_ISL_417203, EPI_ISL_417204, EPI_ISL_417808, EPI_ISL_417809, EPI_ISL_417813,
EPI_ISL_417374, EPI_ISL_417375, EPI_ISL_417376, EPI_ISL_417814, EPI_ISL_417815, EPI_ISL_417816,
EPI_ISL_417377, EPI_ISL_417379, EPI_ISL_417382, EPI_ISL_417818, EPI_ISL_417819, EPI_ISL_417820,
EPI_ISL_417408, EPI_ISL_417409, EPI_ISL_417410, EPI_ISL_417821, EPI_ISL_417822, EPI_ISL_417823,
EPI_ISL_417411, EPI_ISL_417412, EPI_ISL_417413, EPI_ISL_417824, EPI_ISL_417825, EPI_ISL_417826,
EPI_ISL_417420, EPI_ISL_417435, EPI_ISL_417436, EPI_ISL_417827, EPI_ISL_417829, EPI_ISL_417830,
EPI_ISL_417437, EPI_ISL_417438, EPI_ISL_417439, EPI_ISL_417831, EPI_ISL_417832, EPI_ISL_417833,
EPI_ISL_417440, EPI_ISL_417441, EPI_ISL_417442, EPI_ISL_417834, EPI_ISL_417835, EPI_ISL_417836,
EPI_ISL_417467, EPI_ISL_417468, EPI_ISL_417504, EPI_ISL_417837, EPI_ISL_417838, EPI_ISL_417839,
EPI_ISL_417505, EPI_ISL_417506, EPI_ISL_417507, EPI_ISL_417864, EPI_ISL_417917, EPI_ISL_417918,
EPI_ISL_417508, EPI_ISL_417509, EPI_ISL_417510, EPI_ISL_417920, EPI_ISL_417925, EPI_ISL_417926,
EPI_ISL_417512, EPI_ISL_417513, EPI_ISL_417514, EPI_ISL_417931, EPI_ISL_417932, EPI_ISL_417933,
EPI_ISL_417515, EPI_ISL_417516, EPI_ISL_417517, EPI_ISL_417935, EPI_ISL_417936, EPI_ISL_417937,
EPI_ISL_417526, EPI_ISL_417527, EPI_ISL_417528, EPI_ISL_417938, EPI_ISL_417939, EPI_ISL_417940,
EPI_ISL_417529, EPI_ISL_417530, EPI_ISL_417531, EPI_ISL_417941, EPI_ISL_417942, EPI_ISL_417943,
EPI_ISL_417532, EPI_ISL_417533, EPI_ISL_417534, EPI_ISL_417944, EPI_ISL_417945, EPI_ISL_417946,
EPI_ISL_417536, EPI_ISL_417537, EPI_ISL_417538, EPI_ISL_417947, EPI_ISL_417948, EPI_ISL_417949,
EPI_ISL_417539, EPI_ISL_417540, EPI_ISL_417541, EPI_ISL_417950, EPI_ISL_417951, EPI_ISL_417953,
EPI_ISL_417542, EPI_ISL_417543, EPI_ISL_417544, EPI_ISL_417955, EPI_ISL_417958, EPI_ISL_417959,
EPI_ISL_417545, EPI_ISL_417546, EPI_ISL_417547, EPI_ISL_417960, EPI_ISL_417962, EPI_ISL_417964,
EPI_ISL_417548, EPI_ISL_417550, EPI_ISL_417551, EPI_ISL_417965, EPI_ISL_417966, EPI_ISL_417968,
EPI_ISL_417552, EPI_ISL_417553, EPI_ISL_417554, EPI_ISL_417970, EPI_ISL_417971, EPI_ISL_417973,
EPI_ISL_417555, EPI_ISL_417556, EPI_ISL_417557, EPI_ISL_417974, EPI_ISL_417976, EPI_ISL_417977,
EPI_ISL_417558, EPI_ISL_417559, EPI_ISL_417560, EPI_ISL_417982, EPI_ISL_417983, EPI_ISL_417984,
EPI_ISL_417561, EPI_ISL_417562, EPI_ISL_417563, EPI_ISL_417985, EPI_ISL_418009, EPI_ISL_418017,
EPI_ISL_417564, EPI_ISL_417565, EPI_ISL_417566, EPI_ISL_418018, EPI_ISL_418019, EPI_ISL_418020,
EPI_ISL_417567, EPI_ISL_417568, EPI_ISL_417569, EPI_ISL_418021, EPI_ISL_418022, EPI_ISL_418023,
EPI_ISL_417570, EPI_ISL_417571, EPI_ISL_417572, EPI_ISL_418024, EPI_ISL_418025, EPI_ISL_418026,
EPI_ISL_417573, EPI_ISL_417574, EPI_ISL_417575, EPI_ISL_418027, EPI_ISL_418029, EPI_ISL_418030,
EPI_ISL_417576, EPI_ISL_417577, EPI_ISL_417578, EPI_ISL_418031, EPI_ISL_418032, EPI_ISL_418033,
EPI_ISL_417579, EPI_ISL_417580, EPI_ISL_417581, EPI_ISL_418034, EPI_ISL_418037, EPI_ISL_418038,
EPI_ISL_417582, EPI_ISL_417583, EPI_ISL_417584, EPI_ISL_418040, EPI_ISL_418046, EPI_ISL_418047,
EPI_ISL_417585, EPI_ISL_417586, EPI_ISL_417587, EPI_ISL_418048, EPI_ISL_418050, EPI_ISL_418052,
EPI_ISL_417588, EPI_ISL_417589, EPI_ISL_417590, EPI_ISL_418053, EPI_ISL_418054, EPI_ISL_418063,
EPI_ISL_417591, EPI_ISL_417592, EPI_ISL_417593, EPI_ISL_418064, EPI_ISL_418067, EPI_ISL_418071,
EPI_ISL_417594, EPI_ISL_417595, EPI_ISL_417596, EPI_ISL_418072, EPI_ISL_418073, EPI_ISL_418074,
EPI_ISL_417597, EPI_ISL_417598, EPI_ISL_417599, EPI_ISL_418075, EPI_ISL_418076, EPI_ISL_418077,
EPI_ISL_417600, EPI_ISL_417601, EPI_ISL_417602, EPI_ISL_418078, EPI_ISL_418079, EPI_ISL_418080,
EPI_ISL_417603, EPI_ISL_417604, EPI_ISL_417605, EPI_ISL_418081, EPI_ISL_418082, EPI_ISL_418101,
EPI_ISL_417606, EPI_ISL_417607, EPI_ISL_417608, EPI_ISL_418102, EPI_ISL_418103, EPI_ISL_418104,
EPI_ISL_417609, EPI_ISL_417610, EPI_ISL_417611, EPI_ISL_418105, EPI_ISL_418126, EPI_ISL_418127,
EPI_ISL_417612, EPI_ISL_417613, EPI_ISL_417614, EPI_ISL_418128, EPI_ISL_418129, EPI_ISL_418130,
EPI_ISL_417615, EPI_ISL_417616, EPI_ISL_417617, EPI_ISL_418131, EPI_ISL_418132, EPI_ISL_418133,
EPI_ISL_417618, EPI_ISL_417619, EPI_ISL_417620, EPI_ISL_418134, EPI_ISL_418135, EPI_ISL_418136,
EPI_ISL_417621, EPI_ISL_417622, EPI_ISL_417623, EPI_ISL_418137, EPI_ISL_418138, EPI_ISL_418139,
EPI_ISL_417624, EPI_ISL_417625, EPI_ISL_417626, EPI_ISL_418140, EPI_ISL_418148, EPI_ISL_418149,
EPI_ISL_417627, EPI_ISL_417628, EPI_ISL_417629, EPI_ISL_418150, EPI_ISL_418151, EPI_ISL_418152,
EPI_ISL_417630, EPI_ISL_417631, EPI_ISL_417632, EPI_ISL_418153, EPI_ISL_418154, EPI_ISL_418155,
EPI_ISL_417633, EPI_ISL_417634, EPI_ISL_417635, EPI_ISL_418156, EPI_ISL_418157, EPI_ISL_418158,
EPI_ISL_417636, EPI_ISL_417637, EPI_ISL_417638, EPI_ISL_418159, EPI_ISL_418160, EPI_ISL_418161,
EPI_ISL_417639, EPI_ISL_417640, EPI_ISL_417641, EPI_ISL_418162, EPI_ISL_418163, EPI_ISL_418164,
EPI_ISL_417642, EPI_ISL_417643, EPI_ISL_417644, EPI_ISL_418165, EPI_ISL_418183, EPI_ISL_418184,
EPI_ISL_417645, EPI_ISL_417646, EPI_ISL_417647, EPI_ISL_418185, EPI_ISL_418186, EPI_ISL_418187,
EPI_ISL_417648, EPI_ISL_417649, EPI_ISL_417650, EPI_ISL_418188, EPI_ISL_418189, EPI_ISL_418190,
EPI_ISL_417651, EPI_ISL_417652, EPI_ISL_417653, EPI_ISL_418191, EPI_ISL_418192, EPI_ISL_418193,
EPI_ISL_417654, EPI_ISL_417666, EPI_ISL_417667, EPI_ISL_418194, EPI_ISL_418195, EPI_ISL_418197,
EPI_ISL_417668, EPI_ISL_417669, EPI_ISL_417670, EPI_ISL_418198, EPI_ISL_418199, EPI_ISL_418200,
EPI_ISL_417671, EPI_ISL_417672, EPI_ISL_417676, EPI_ISL_418201, EPI_ISL_418202, EPI_ISL_418203,
EPI_ISL_417678, EPI_ISL_417680, EPI_ISL_417685, EPI_ISL_418204, EPI_ISL_418231, EPI_ISL_418232,
EPI_ISL_417699, EPI_ISL_417700, EPI_ISL_417703, EPI_ISL_418233, EPI_ISL_418235, EPI_ISL_418236, EPI_ISL_418237, EPI_ISL_418238, EPI_ISL_418239, EPI_ISL_418240, EPI_ISL_418257, EPI_ISL_418260, EPI_ISL_418263, EPI_ISL_418264, EPI_ISL_418265 or EPI_ISL_616802 (hCoV-19/Denmark/DCGC-3024/2020).

Exemplary SARS-CoV-2 coronaviruses can also be defined or identified by genetic information provided by GenBank Accession Numbers as provided in List B below.

List B: GenBank Accession Numbers of Different SARS-CoV-2 Isolates:

NC_045512, LC528232, LC528233, LC529905, MN908947, MN938384, MN938385, MN938386, MN938387, MN938388, MN938389, MN938390, MN970003, MN970004, MN975262, MN975263, MN975264, MN975265, MN975266, MN975267, MN975268, MN985325, MN988668, MN988669, MN994467, MN994468, MN996527, MN996528, MN996529, MN996530, MN996531, MN997409, MT007544, MT012098, MT019529, MT019530, MT019531, MT019532, MT019533, MT020880, MT020881, MT027062, MT027063, MT027064, MT039873, MT039887, MT039888, MT039890, MT044257, MT044258, MT049951, MT050493, MT066156, MT066175, MT066176, MT072688, MT093571, MT093631, MT106052, MT106053, MT106054, MT118835, MT121215, MT123290, MT123291, MT123292, MT123293, MT126808, MT135041, MT135042, MT135043, MT135044, MT152824, MT159705, MT159706, MT159707, MT159708, MT159709, MT159710, MT159711, MT159712, MT159713, MT159714, MT159715, MT159716, MT159717, MT159718, MT159719, MT159720, MT159721, MT159722, MT163716, MT163717, MT163718, MT163719, MT163720, MT163721, MT184907, MT184908, MT184909, MT184910, MT184911, MT184912, MT184913, MT188339, MT188340, MT188341, MT192759, MT192765, MT192772 or MT192773.

SARS-CoV-2 coronavirus has been attributed the NCBI Taxonomy ID (NCBI: txid or taxID): 2697049.

The term "antigenic peptide or protein of an nCoV-2019 coronavirus" or "antigenic peptide or protein of a SARS-CoV-2 coronavirus" relates to any peptide or protein that is (from) or is derived from a SARS-CoV-2 (nCoV-2019) coronavirus as defined above, but also to fragments, variants or derivatives thereof, preferably to immunogenic fragments or immunogenic variants thereof.

The term "immunogenic fragment" or "immunogenic variant" has to be understood as any fragment/variant of the corresponding SARS-CoV-2 (nCoV-2019) coronavirus antigen that is capable of raising an immune response in a subject. Preferably, intramuscular or intradermal administration of the nucleic acid of the first aspect results in expression of the encoded SARS-CoV-2 antigen (peptide or protein) in a subject.

The term "expression" as used herein refers to the production of a SARS-CoV-2 coronavirus peptide or protein, wherein said SARS-CoV-2 coronavirus peptide or protein is provided by a coding sequence of a nucleic acid of the first aspect. For example, "expression" of an RNA refers to production of a protein (e.g. after administration of said RNA to a cell or a subject) via translation of the RNA into a polypeptide, e.g. into a peptide or protein that is or is derived from a SARS-CoV-2 coronavirus. "Expression" of a DNA refers to production of a protein (e.g. after administration of said DNA to a cell or a subject) via transcription of the DNA into RNA and subsequent translation into a polypeptide, e.g. into a peptide or protein that is or is derived from a SARS-CoV-2 coronavirus. The term "expression" and the term "production" may be used interchangeably herein. Further, the term "expression" preferably relates to production of a certain peptide or protein upon administration of a nucleic acid to a cell or an organism. In embodiments, the nucleic acid is suitable for a vaccine, preferably a coronavirus vaccine. In preferred embodiments, the nucleic acid is suitable for a SARS-CoV-2 coronavirus vaccine.

In the context of the invention, any protein that is or is derived from a SARS-CoV-2 coronavirus may be used and may be suitably encoded by the coding sequence or the nucleic acid of the first aspect. It is further in the scope of the underlying invention, that the at least one antigenic peptide or protein may comprise or consist of a synthetically engineered or an artificial coronavirus peptide or protein. The term "synthetically engineered" coronavirus peptide or protein, or the term "artificial coronavirus peptide or protein" relates to a protein that does not occur in nature. Accordingly, an "artificial coronavirus peptide or protein" or a "synthetically engineered coronavirus peptide or protein" may for example differ in at least one amino acid compared to the natural coronavirus peptide or protein, and/or may comprise an additional heterologous peptide or protein element, and/or may be N-terminally or C-terminally extended or truncated.

In preferred embodiments, the nucleic acid comprises at least one coding sequence encoding at least one antigenic peptide or protein of SARS-CoV-2 coronavirus, or an immunogenic fragment or immunogenic variant thereof, wherein the at least one antigenic peptide or protein comprises at least one peptide or protein that is or is derived from a structural protein, an accessory protein, or a replicase protein or an immunogenic fragment or immunogenic variant of any of these.

In preferred embodiments, the nucleic acid comprises at least one coding sequence encoding at least one antigenic peptide or protein of SARS-CoV-2 coronavirus, wherein the at least one antigenic peptide or protein comprises at least one peptide or protein that is or is derived from a structural protein, wherein the structural protein is selected from a spike protein (S), an envelope protein (E), a membrane protein (M) or a nucleocapsid protein (N), or an immunogenic fragment or variant of any of these.

In particularly preferred embodiments, the encoded at least one antigenic peptide or protein comprises or consists of a spike protein (S), or an immunogenic fragment or immunogenic variant thereof.

Spike protein is a typical type I viral fusion protein that exists as trimer on the viral surface with each monomer consisting of a Head (S1) and stem (S2). Individual precursor S polypeptides form a homotrimer and undergo glycosylation within the Golgi apparatus as well as processing to remove the signal peptide, and cleavage by a cellular protease to generate separate S1 and S2 polypeptide chains, which remain associated as S1/S2 protomers within the homotrimer and is therefore a trimer of heterodimers. The S1 domain of the spike glycoprotein includes the receptor binding domain (RBD) that engages (most likely) with the angiotensin-converting enzyme 2 receptors and mediates viral fusion into the host cell, an N-terminal domain that may make initial contact with target cells, and 2 subdomains, all of which are susceptible to neutralizing antibodies. S2 domain consists of a six helix bundle fusion core involved in membrane fusion with the host endosomal membrane and is also a target for neutralization. The S2 subunit further comprises two heptad-repeat sequences (HR1 and HR2) and a central helix typical of fusion glycoproteins, a transmembrane domain, and the cytosolic tail domain.

Suitable antigenic peptide or protein sequences that are provided by the nucleic acid of the invention are disclosed in Table 1, rows 1 to 41, Column A and B. In addition, further information regarding said suitable antigenic peptide or protein sequences are provided under <223> identifier of the ST25 sequence listing.

In the following, preferred antigenic peptide or protein sequences that are provided by the nucleic acid of the invention are described in detail.

In preferred embodiments, the encoded at least one antigenic peptide or protein comprises or consists of at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-111, 274-11663, 13176-13510, 13521-14123, 22732-22758, 22917, 22923, 22929-22964, 26938, 26939 or an immunogenic fragment or immunogenic variant of any of these. Further information regarding said amino acid sequences is also provided in Table 1 (see rows 1 to 41 of Column A and B), and under <223> identifier of the ST25 sequence listing of respective sequence SEQ ID NOs.

It has to be noted that where reference is made to amino acid (aa) residues and their position in a spike protein (S), any numbering used herein—unless stated otherwise—relates to the position of the respective amino acid residue in a corresponding spike protein (S) of SARS-CoV-2 (nCoV-2019) coronavirus isolate EPI_ISL_402128 (BetaCoV_Wuhan_WIV05_2019_EPI_ISL_402128) according to SEQ ID NO: 1. Respective amino acid positions are, throughout the disclosure, exemplarily indicated for spike protein (S) of SARS-CoV-2 coronavirus isolate EPI_ISL_402128 (SEQ ID NO: 1). The person skilled in the art will of course be able to adapt the teaching provided in the present specification exemplified for SARS-CoV-2 EPI_ISL_402128 (SEQ ID NO: 1) to other antigenic peptides or proteins in other SARS-CoV-2 coronavirus isolates, e.g. to isolates including but not limited to EPI_ISL_404227, EPI_ISL_403963, EPI_ISL_403962, EPI_ISL_403931, EPI_ISL_403930, EPI_ISL_403929, EPI_ISL_402130, EPI_ISL_402129, EPI_ISL_402128, EPI_ISL_402126, EPI_ISL_402125, EPI_ISL_402124, EPI_ISL_402123, EPI_ISL_402120, EPI_ISL_402119 (further SARS-CoV-2 isolates are provided in List A and/or List B and or Table 25).

Protein annotation was performed using SEQ ID NO: 1 as a reference protein. The full-length spike protein (S) of SARS-CoV-2 coronavirus reference protein has 1273 amino acid residues, and comprises the following elements:
  secretory signal peptide: amino acid position aa 1 to aa 15 (see SEQ ID NO: 28)
  spike protein fragment S1: amino acid position aa 1 to aa 681 (see SEQ ID NO: 27)
  receptor binding domain (RBD): amino acid position aa 319 to aa 541 (see SEQ ID NO: 13243)
  critical neutralisation domain (CND): amino acid position aa 329 to aa 529 (see SEQ ID NO: 13310)
  spike protein fragment S2: amino acid position aa 682 to aa 1273 (see SEQ ID NO: 30)
  transmembrane domain (TM) amino acid position aa 1212 to aa 1273 (see SEQ ID NO: 49)
  transmembrane domain (TMflex) amino acid position aa 1148 to aa 1273 (see SEQ ID NO: 13176)

It has to be noted that variation on amino acid level naturally occurs between spike proteins derived from different SARS-CoV-2 isolates (exemplary SARS-CoV-2 isolates are provided in List A and List B). In the context of the invention, such amino acid variations can be applied to each antigenic peptide or protein derived from a spike protein as described herein.

Accordingly, each spike protein provided herein and contemplated as suitable antigen in the context of the invention may have one or more of the following amino acid variations (amino acid positions according to reference SEQ ID NO: 1):
  D614G or G614D
  H49Y or Y49H
  V367F or F367V
  P1263L or L1263P
  V483A or A483V
  S939F or F939S
  S943P or P943S
  L5F or F5L
  L8V or V8L
  S940F or F940S
  C1254F or F1254C
  Q239K or K239Q
  M153T or T153M
  V1040F or F1040V
  A845S or S845A
  Y145H or H145Y
  A831V or V831A
  M1229I or I1229M
  H69 or H69del/aa deleted
  V70 or H70del/aa deleted
  H69_V70 or H69del and H70del/aa deleted
  A222V or V222A
  Y453F or F453Y
  S477N or N477S
  I692V or V692I
  R403K or K403R
  K417N or N417K
  N437S or S437N
  N439K or K439N
  V445A or A445V
  V445I or I445V
  V445F or F445V
  G446V or V446G
  G446S or S446G
  G446A or A446G
  L455F or F455L
  F456L or L456F
  K458N or N458K
  A475V or V475A
  G476S or S476G
  G476A or A476G
  S477I or I477S
  S477R or R477S
  S477G or G477S
  S477T or T477S
  T478I or I478T
  T478K or K478T
  T478R or R478T
  T478A or A478T
  E484Q or Q484E
  E484K or K484E
  E484A or A484E
  E484D or D484E
  G485R or R485G
  G485S or S485G
  F486L or L486F
  N487I or I487N
  Y489H or H489Y F490S or S490F
F490L or L490F
Q493L or L493Q
Q493K or K493Q
S494P or P494S
S494L or L494S
P499L or L499P
T500I or I500T
N501Y or Y501N
N501T or T501N
N501S or S501N
V503F or F503V
V503I or I503V
G504D or D504G
Y505W or W505Y
Q506K or K506Q
0506H or H506O
Y144 or Y144del/aa deleted
A570D or D570A
P681H or H681P
T716I or I716T
S982A or A982S
D1118H or H1118D
L18F or F18L
D80A or A80D
D215G or G215D
L242 or L242del/aa deleted
A243 or A243del/aa deleted
L244 or L244del/aa deleted
L242_A243_L244 or L242del and A243del and L244del/aa deleted
R246I or I246R
A701V or V701A
T20N or N20T
P26S or S26P
D138Y or Y138D
R190S or S190R
H655Y or Y655H
T1027I or I1027T
S13I or I13S
W152C or C152W
L452R or R452L
R346T or T346R
P384L or L384P
L452M or M452L
F456A or A456F
F456K or K456F
F456V or V456F
E484P or P484E
K417T or T417K
G447V or V447G
L452Q or Q452L
A475S or S475A
F486I or I486F
F490Y or Y490F
Q493R or R493Q
S494A or A494S
P499H or H499P
P499S or S499P
G502V or V502G
T748K or K748T
A522S or S522A
V1176F or F1176V The following amino acid variations (amino acid positions according to reference SEQ ID NO: 1) are particularly preferred:

H69del, V70del, Y144del, N501Y, A570D, D614G, P681H, T716I, S982A, and D1118H
L18F, D80A, D215G, L242del, A243del, L244del, R246I, K417N, E484K, N501Y, D614G, and A701V
K417N, E484K, N501Y, and D614G
E484K and D614G
L18F, T20N, P26S, D138Y, R190S, K417T, E484K, N501Y, D614G, H655Y, and T1027I
S13I, W152C, L452R, and D614G
delH69, delV70, Y453F, D614G, I692V, and M1229I
E484K, E484P, or E484Q
G446V
G485R In some embodiments, a fragment of a spike protein (S) may be encoded by the nucleic acid of the invention, wherein said fragment may be N-terminally truncated, lacking the N-terminal amino acids 1 to up to 100 of the full length SARS-CoV-2 coronavirus reference protein (SEQ ID NO: 1) and/or wherein said fragment may be C-terminally truncated, lacking the C-terminal amino acids (aa) 531 to up to aa 1273 of the full length SARS-CoV-2 coronavirus reference protein (SEQ ID NO: 1). Such "fragment of a spike protein (S)" may additionally comprise amino acid substitutions (as described below) and may additionally comprise at least one heterologous peptide or protein element (as described below). In preferred embodiments, a fragment of a spike protein (S) may be C-terminally truncated, thereby lacking the C-terminal transmembrane domain (that is, lacking aa 1212 to aa 1273 or lacking aa 1148 to aa 1273).

In other embodiments, the encoded at least one antigenic peptide or protein comprises or consists of a spike protein (S), wherein the spike protein (S) derived from SARS-CoV-2 coronavirus lacks the transmembrane domain (TM) (amino acid position aa 1212 to aa 1273). In embodiments, the encoded at least one antigenic peptide or protein comprises or consists of a spike protein (S), wherein the spike protein (S) derived from SARS-CoV-2 coronavirus lacks an extended part of the transmembrane domain (TMflex) (amino acid position aa 1148 to aa 1273). Without wishing to being bound to theory, a spike protein (S) lacking the transmembrane domain (TM or TMflex) as defined herein could be suitable for a coronavirus vaccine, as such a protein would be soluble and not anchored in the cell membrane. A soluble protein may therefore be produced (that is translated) in higher concentrations upon administration to a subject, leading to improved immune responses.

Without wishing to being bound to theory, RBD (aa 319 to aa 541) and CND (aa 29 to aa 529) domains may be crucial for immunogenicity. Both regions are located at the S1 fragment of the spike protein. Accordingly, it may be suitable in the context of the invention that the antigenic peptide or protein comprises or consists of an S1 fragment of the spike protein or an immunogenic fragment or immunogenic variant thereof. Suitably, such an S1 fragment may comprise at least an RBD and/or a CND domain as defined above.

In preferred embodiments, the encoded at least one antigenic peptide or protein comprises or consists of a receptor-binding domain (RBD; aa 319 to aa 541), wherein the RBD comprises or consists of a spike protein fragment, or an immunogenic fragment or immunogenic variant thereof.

In further preferred embodiments, the encoded at least one antigenic peptide or protein comprises or consists of a truncated receptor-binding domain (truncRBD; aa 334 to aa 528), wherein the RBD comprises or consists of a spike protein fragment, or an immunogenic fragment or immunogenic variant thereof.

Such "fragment of a spike protein (S)" (RBD; aa 319 to aa 541 or truncRBD, aa 334 to aa 528), may additionally comprise amino acid substitutions (as described below) and may additionally comprise at least one heterologous peptide or protein element (as described below).

In particularly preferred embodiments, the encoded at least one antigenic peptide or protein comprises or consists of a spike protein (S), wherein the spike protein (S) comprises or consists of a spike protein fragment S1, or an immunogenic fragment or immunogenic variant thereof.

Accordingly, in preferred embodiments, the encoded at least one antigenic peptide or protein (comprising or consisting of a spike protein fragment S1) comprises or consists of at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-27, 29, 31-48, 58-111, 274-1345, 1480-1546, 1614-11663, 13377-13510, 13521-14123, 22732, 22737-22758, 22929-22964 or an immunogenic fragment or immunogenic variant of any of these. Further information regarding said amino acid sequences is also provided in Table 1 (see rows 1 to 6, 9, 11-41 of Column A and B), and under <223> identifier of the ST25 sequence listing of respective sequence SEQ ID NOs.

In preferred embodiments, the encoded at least one antigenic peptide or protein comprises an spike protein fragment S1, and lacks at least 70%, 80%, 90%, preferably 100% of spike protein fragment S2 (aa 682 to aa 1273). Such embodiments may be beneficial, as the S1 fragment comprises neutralizing epitopes without potential problems of full-length protein comprising S1 and S2.

Accordingly, in preferred embodiments, the encoded at least one antigenic peptide or protein (essentially consisting of a spike protein fragment S1) comprises or consists of at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 27, 1279-1345, 29, 1480-1546, 13243-13309, 22733-22736, 26938, 26939 or an immunogenic fragment or immunogenic variant of any of these. Further information regarding said amino acid sequences is also provided in Table 1 (see rows 6 and 9 of Column A and B), and under <223> identifier of the ST25 sequence listing of respective sequence SEQ ID NOs.

Without wishing to being bound to theory, it may be suitable that the antigenic peptide or protein comprises or consists of spike protein fragment S1 and (at least a fragment of) spike protein fragment S2, because the formation of an immunogenic spike protein may be promoted.

Accordingly, in particularly preferred embodiments, the encoded at least one antigenic peptide or protein comprises or consists of a spike protein (S), wherein the spike protein (S) comprises or consists of a spike protein fragment S1 or an immunogenic fragment or immunogenic variant thereof, and spike protein fragment S2 or an immunogenic fragment or immunogenic variant thereof.

In preferred embodiments, the at least one encoded antigenic peptide or protein that comprises or consists of spike protein fragment S1 and spike protein fragment S2, comprises at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-26, 31-48, 58-111, 274-1278, 1614-11663, 13377-13510, 13521-14177, 22732, 22737-22758, 22929-22964 or an immunogenic fragment or immunogenic variant of any of these. Further information regarding said amino acid sequences is also provided in Table 1 (see rows 1 to 5, 11-35, 38 of Column A and B), and under <223> identifier of the ST25 sequence listing of respective sequence SEQ ID NOs.

In particularly preferred embodiments, the encoded at least one antigenic peptide or protein comprises or consists of a full-length spike protein or an immunogenic fragment or immunogenic variant of any of these.

The term "full length spike protein" has to be understood as a spike protein, preferably derived from a SARS-CoV-2 coronavirus, having an amino acid sequence corresponding to essentially the full spike protein. Accordingly, a "full length spike protein" may comprise aa 1 to aa 1273 (reference protein: SEQ ID NOs: 1). Accordingly, a full length spike protein may typically comprise a secretory signal peptide, a spike protein fragment S1, a spike protein fragment S2, a receptor binding domain (RBD), and a critical neutralisation domain CND, and a transmembrane domain. Notably, also variants that comprise certain amino acid substitutions (e.g. for allowing pre-fusion stabilization of the S protein) or natural occurring amino acid deletions are encompassed by the term "full length spike protein".

Accordingly, in preferred embodiments, the at least one encoded antigenic peptide or protein is a full length S protein comprising or consisting of at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-9, 274-340, 22737, 22739, 22741, 22743, 22745, 22747, 22749, 22751, 22753, 22755, 22757, 22929-22946 or an immunogenic fragment or immunogenic variant of any of these. Further information regarding said amino acid sequences is also provided in Table 1 (see row 1 of Column A and B), and under <223> identifier of the ST25 sequence listing of respective sequence SEQ ID NOs.

In particularly preferred embodiments, the spike protein (S) that is provided by the nucleic acid of the first aspect is designed or adapted to stabilize the antigen in pre-fusion conformation. A pre-fusion conformation is particularly advantageous in the context of an efficient coronavirus vaccine, as several potential epitopes for neutralizing antibodies may merely be accessible in said pre-fusion protein conformation. Furthermore, remaining of the protein in the pre-fusion conformation is aimed to avoid immunopathological effects, like e.g. enhanced disease and/or antibody dependent enhancement (ADE).

In preferred embodiments, administration of a nucleic acid (or a composition or vaccine) encoding pre-fusion stabilized spike protein to a subject elicits spike protein neutralizing antibodies and does not elicit disease-enhancing antibodies. In particular, administration of a nucleic acid (or a composition or vaccine) encoding pre-fusion stabilized spike protein to a subject does not elicit immunopathological effects, like e.g. enhanced disease and/or antibody dependent enhancement (ADE).

Accordingly, in preferred embodiments, the nucleic acid of the invention comprises at least one coding sequence encoding at least one antigenic peptide or protein that is or is derived from an SARS-CoV-2 coronavirus, wherein the at least one antigenic peptide or protein is or is derived from a spike protein (S), wherein the spike protein (S) is a pre-fusion stabilized spike protein (S_stab). Suitably, said pre-fusion stabilized spike protein comprises at least one pre-fusion stabilizing mutation.

The term "pre-fusion conformation" as used herein relates to a structural conformation adopted by the ectodomain of the coronavirus S protein following processing into a mature coronavirus S protein in the secretory system, and prior to triggering of the fusogenic event that leads to transition of coronavirus S to the postfusion conformation.

A "pre-fusion stabilized spike protein (S_stab)" as described herein comprises one or more amino acid substitutions, deletions, or insertions compared to a native coronavirus S sequence that provide for increased retention of the prefusion conformation compared to coronavirus S ectodomain trimers formed from a corresponding native coronavirus S sequence. The "stabilization" of the prefusion conformation by the one or more amino acid substitutions, deletions, or insertions can be, for example, energetic stabilization (for example, reducing the energy of the prefusion conformation relative to the post-fusion open conformation) and/or kinetic stabilization (for example, reducing the rate of transition from the prefusion conformation to the postfusion conformation). Additionally, stabilization of the coronavirus S ectodomain trimer in the prefusion conformation can include an increase in resistance to denaturation compared to a corresponding native coronavirus S sequence.

Accordingly, in preferred embodiments, the spike protein includes one or more amino acid substitutions that stabilize the S protein in the pre-fusion conformation, for example, substitutions that stabilize the membrane distal portion of the S protein (including the N-terminal region) in the pre-fusion conformation.

Stabilization of the SARS-CoV-2 coronavirus spike protein may be obtained by substituting at least one amino acid at position K986 and/or V987 with amino acids that stabilize the spike protein in a perfusion conformation (amino acid positions according to reference SEQ ID NO: 1).

In particularly preferred embodiments, the pre-fusion stabilizing mutation comprises an amino acid substitution at position K986, wherein the amino acids K986 is substituted with one selected from A, I, L, M, F, V, G, or P (amino acid positions according to reference SEQ ID NO: 1), preferably wherein the amino acids K986 is substituted with P. In additionally preferred embodiments, the pre-fusion stabilizing mutation comprises an amino acid substitution at position K986, wherein the amino acids V987 is substituted with one selected from A, I, L, M, F, V, G, or P (amino acid positions according to reference SEQ ID NO: 1), preferably wherein the amino acids V987 is substituted with P.

Suitably, stabilization of the SARS-CoV-2 coronavirus spike protein may be obtained by substituting two consecutive amino acids at position K986 and V987 with amino acids that stabilize the spike protein in a prefusion conformation (Amino acid positions according to reference SEQ ID NO: 1).

In preferred embodiments, the pre-fusion stabilizing mutation comprises an amino acid substitution at position K986 and V987, wherein the amino acids K986 and/or V987 are substituted with one selected from A, I, L, M, F, V, G, or P (amino acid positions according to reference SEQ ID NO: 1).

Preferably, stabilization of the perfusion conformation is obtained by introducing two consecutive proline substitutions at residues K986 and V987 in the spike protein (Amino acid positions according to reference SEQ ID NO: 1).

Accordingly, in preferred embodiments, the pre-fusion stabilized spike protein (S_stab) comprises at least one pre-fusion stabilizing mutation, wherein the at least one pre-fusion stabilizing mutation comprises the following amino acid substitutions: K986P and V987P (amino acid positions according to reference SEQ ID NO: 1).

Accordingly, any NCBI Protein Accession numbers provided above, or any protein selected from SEQ ID NOs: 1-9, 274-340, 22737, 22739, 22741, 22743, 22745, 22747, 22749, 22751, 22753, 22755, 22757, 22929-22946 or fragments or variants thereof can be chosen by the skilled person to introduce such amino acid changes, preferably amino acid substitutions: K986P and V987P (amino acid positions according to reference SEQ ID NO: 1).

In preferred embodiments, the at least one pre-fusion stabilizing mutation comprises a cavity filling mutation that further stabilizes the pre-fusion state, wherein said mutation/amino acid substitution is selected from the list comprising T887WN; A1020W; T887WN and A1020W; or P1069F (amino acid positions according to reference SEQ ID NO: 1).

The term "cavity filling mutation" or "cavity filling amino acid substitution" relates to an amino acid substitution that fills a cavity within the protein core of a protein, such as a coronavirus S protein ectodomain. Cavities are essentially voids within a folded protein where amino acids or amino acid side chains are not present. In several embodiments, a cavity-filling amino acid substitution is introduced to fill a cavity present in the prefusion conformation of a coronavirus S ectodomain core that collapses (e.g., has reduced volume) after transition to the postfusion conformation.

In some embodiments, at least one of the following amino acid substitutions F817P, A892P, A899P and A942P may be combined with a (K986P and V987P) substitution (amino acid positions according to reference SEQ ID NO: 1).

In preferred embodiments, the SARS-CoV-2 coronavirus spike protein comprises at least one of the following amino acid substitutions (Amino acid positions according to reference SEQ ID NO: 1):

F817P; K986P and V987P

A892P; K986P and V987P

A899P; K986P and V987P

A942P; K986P and V987P

In particularly preferred embodiments, the SARS-CoV-2 coronavirus spike protein comprises the following amino acid substitutions (Amino acid positions according to reference SEQ ID NO: 1):

F817P, A892P, A899P, A942P, K986P and V987P (S_stab_PP_hex)

Accordingly, any NCBI protein accession numbers provided above, or any protein selected from SEQ ID NOs: 1-9, 274-340, 22737, 22739, 22741, 22743, 22745, 22747, 22749, 22751, 22753, 22755, 22757, 22929-22946 or fragments or variants thereof can be chosen by the skilled person to introduce such amino acid changes, suitably amino acid substitutions selected from F817P, A892P, A899P, A942P; or amino acid substitutions selected from (F817P; K986P and V987P); (A892P; K986P and V987P); (A899P; K986P and V987P); (A942P; K986P and V987P); (F817P, A892P, A899P, A942P, K986P and V987P) (amino acid positions according to reference SEQ ID NO: 1).

In particularly preferred embodiments, at least one of the following amino acid substitutions T887W; A1020W; T887W and A1020W; or P1069F may be combined with a (K986P and V987P) substitution (amino acid positions according to reference SEQ ID NO: 1).

In other particularly preferred embodiments, the SARS-CoV-2 coronavirus spike protein comprises at least one of the following amino acid substitutions (Amino acid positions according to reference SEQ ID NO: 1):

T887W; K986P and V987P
A1020W; K986P and V987P
T887W and A1020W; K986P and V987P
P1069F; K986P and V987P Accordingly, any NCBI protein accession numbers provided above, or any protein selected from SEQ ID NOs: 1-9, 274-340, 22737, 22739, 22741, 22743, 22745, 22747, 22749, 22751, 22753, 22755, 22757, 22929-22946 or fragments or variants thereof can be chosen by the skilled person to introduce such amino acid changes, suitably amino acid substitutions selected from T887W; A1020W; T887W and A1020W; or P1069F; or amino acid substitutions selected from (T887W; K986P and V987P); (A1020W; K986P and V987P); (T887W and A1020W; K986P and V987P); (P1069F; K986P and V987P) (amino acid positions according to reference SEQ ID NO: 1).

In preferred embodiments, the at least one pre-fusion stabilizing mutation comprises a mutated protonation site that further stabilizes the pre-fusion state, wherein said mutation/amino acid substitution is selected from H1048Q and H1064N; H1083N and H1101N; or H1048Q and H1064N and H1083N and H1101N (amino acid positions according to reference SEQ ID NO: 1).

In some embodiments, at least one of the following amino acid substitutions H1048Q and H1064N; H1083N and H1101N; or H1048Q and H1064N and H1083N and H1101N may be combined with a (K986P and V987P) substitution (amino acid positions according to reference SEQ ID NO: 1).

In particularly preferred embodiments, the SARS-CoV-2 coronavirus spike protein comprises at least one of the following amino acid substitutions (Amino acid positions according to reference SEQ ID NO: 1):

H1048Q and H1064N; K986P and V987P
H1083N and H1101N; K986P and V987P
H1048Q and H1064N and H1083N and H1101N; K986P and V987P Accordingly, any NCBI protein accession numbers provided above, or any protein selected from SEQ ID NOs: 1-9, 274-340, 22737, 22739, 22741, 22743, 22745, 22747, 22749, 22751, 22753, 22755, 22757, 22929-22946 or fragments or variants thereof can be chosen by the skilled person to introduce such amino acid changes, suitably amino acid substitutions selected from H1048Q and H1064N; H1083N and H1101N; or H1048Q and H1064N and H1083N and H1101N; or amino acid substitutions selected from (H1048Q and H1064N; K986P and V987P); (H1083N and H1101N; K986P and V987P); (H1048Q and H1064N and H1083N and H1101N; K986P and V987P); (amino acid positions according to reference SEQ ID NO: 1).

In preferred embodiments, the at least one pre-fusion stabilizing mutation comprises an artificial intramolecular disulfide bond. Such an artificial intramolecular disulfide bond can be introduced to further stabilize the membrane distal portion of the S protein (including the N-terminal region) in the pre-fusion conformation; that is, in a conformation that specifically binds to one or more pre-fusion specification antibodies, and/or presents a suitable antigenic site that is present on the pre-fusion conformation but not in the post fusion conformation of the S protein.

In preferred embodiments, the at least one pre-fusion stabilizing mutation generates an artificial intramolecular disulfide bond, wherein the at least one artificial intramolecular disulfide bond is generated by at least two of the following amino acid substitutions selected from the list comprising 17120, 17140, P715C, T874C, G889C, A890C, 19090, N914C, Q965C, F970C, A972C, R995C, G999C, S1003C, L1034C, V1040C, Y1047C, S1055C, P1069C, T1077C, or Y1110C, S1123C (amino acid positions according to reference SEQ ID NO: 1).

In preferred embodiments, the at least one pre-fusion stabilizing mutation generates an artificial intramolecular disulfide bond, wherein the at least one artificial intramolecular disulfide bond is generated by at least one of the following amino acid substitutions: I712C and T1077C; I714C and Y1110C; P715C and P1069C; G889C and L1034C; 19090 and Y1047C; Q965C and S1003C; F970C and G999C; A972C and R995C; A890C and V1040C; T874C and S1055C, or N914C and S1123C (amino acid positions according to reference SEQ ID NO: 1).

In further embodiments, the at least one pre-fusion stabilizing mutation comprises 2, 3, 4, 5, 6, 7, or 8 different artificial intramolecular disulfide bonds, wherein each may be selected from the following amino acid substitutions:

I712C and T1077C; I714C and Y1110C; P715C and P1069C; G889C and L1034C; 19090 and Y1047C; Q965C and S1003C; F970C and G999C; A972C and R995C; A890C and V1040C; T874C and S1055C, or N914C and S1123C (amino acid positions according to reference SEQ ID NO: 1).

In additional embodiments, at least one, preferably 2, 3, 4, 5 or more of the following amino acid substitutions 17120 and T1077C; I714C and Y1110C; P715C and P1069C; G889C and L1034C; 19090 and Y1047C; Q965C and S1003C; F970C and G999C; A972C and R995C; A890C and V1040C; T874C and S1055C, or N914C and S1123C may be combined with a (K986P and V987P) substitution. For example, a pre-fusion stabilized S protein may comprise two different artificial intramolecular disulfide bonds, e.g. I712C and T1077C; P715C and P1069C; and additionally a K986P and V987P substitution, etc. (amino acid positions according to reference SEQ ID NO: 1).

In particularly preferred embodiments, the SARS-CoV-2 coronavirus spike protein comprises at least one of the following amino acid substitutions (amino acid positions according to reference SEQ ID NO: 1):

I712C and T1077C; K986P and V987P
I714C and Y1110C; K986P and V987P
P715C and P1069C; K986P and V987P
G889C and L1034C; K986P and V987P
19090 and Y1047C; K986P and V987P
Q965C and S1003C; K986P and V987P
F970C and G999C; K986P and V987P
A972C and R995C; K986P and V987P
A890C and V1040C; K986P and V987P
T874C and S1055C; K986P and V987P
N914C and S1123C; K986P and V987P Accordingly, any NCBI protein accession numbers provided above, or any protein selected from SEQ ID NOs: 1-9, 274-340, 22737, 22739, 22741, 22743, 22745, 22747, 22749, 22751, 22753, 22755, 22757, 22929-22946 or fragments or variants thereof can be chosen by the skilled person to introduce such amino acid changes, suitably amino acid substitutions selected from I712C and T1077C; I714C and Y1110C; P715C and P1069C; G889C and L1034C; 19090 and Y1047C; Q965C and S1003C; F970C and G999C; A972C and R995C; A890C and V1040C; T874C and S1055C, or N914C and S1123C; or amino acid substitutions selected from (I712C; T1077C; K986P; V987P) or (I714C; Y1110C; K986P; V987P) or (P715C; P1069C; K986P;

V987P) or (G889C; L1034C; K986P; V987P) or (I909C; Y1047C; K986P; V987P) or (Q965C; S1003C; K986P; V987P) or (F970C; G999C; K986P; V987P) or (A972C; R995C; K986P; V987P) or (A890C and V1040C; K986P and V987P) or (T874C and S1055C; K986P and V987P) or (N914C and S1123C; K986P and V987P) (amino acid positions according to reference SEQ ID NO: 1).

It has to be emphasized that in the context of the invention any SARS-CoV-2 coronavirus spike protein may be mutated as described above (exemplified for reference protein SEQ ID NO: 1) to stabilize the spike protein in the pre-fusion conformation.

Accordingly, in preferred embodiments, the pre-fusion stabilized spike protein (S_stab) comprises or consists of at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 10-26, 40-48, 85-111, 341-1278, 1681-2618, 2686-3623, 3691-4628, 4696-5633, 5701-6638, 6706-7643, 7711-8648, 8716-9653, 9721-10658, 10726-11663, 13377-13510, 13521-14123, 22732, 22738, 22740, 22742, 22744, 22746, 22748, 22750, 22752, 22754, 22756, 22758, 22947-22964 or an immunogenic fragment or immunogenic variant of any of these. Further information regarding said amino acid sequences is also provided in Table 1 (see rows 2 to 5, 12-15, 17-20, 22-25, 27-30, 32-35, 38 of Column A and B), and under <223> identifier of the ST25 sequence listing of respective sequence SEQ ID NOs.

In particularly preferred embodiments, the pre-fusion stabilized spike protein (S_stab) comprises or consists of at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 10-26, 341-407, 609-1278, 13521-13587, 22738, 22740, 22742, 22744, 22746, 22748, 22750, 22752, 22754, 22756, 22758, 22947-22964 or an immunogenic fragment or immunogenic variant of any of these. Further information regarding said amino acid sequences is also provided in Table 1 (see rows 2 and 5 of Column A and B), and under <223> identifier of the ST25 sequence listing of respective sequence SEQ ID NOs.

In a more preferred embodiment, the pre-fusion stabilized spike protein (S_stab) comprises or consists of at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 10-18, 341-407, 22947-22964 or an immunogenic fragment or immunogenic variant of any of these. Further information regarding said amino acid sequences is also provided in Table 1 (see row 2 of Column A and B), and under <223> identifier of the ST25 sequence listing of respective sequence SEQ ID NOs.

In a further, more preferred embodiment, the pre-fusion stabilized spike protein (S_stab) comprises or consists of at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 22960, 22961, 22963 or an immunogenic fragment or immunogenic variant of any of these.

In an even more preferred embodiment, the pre-fusion stabilized spike protein (S_stab) comprises or consists of at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 10 or 341 or an immunogenic fragment or immunogenic variant of any of these.

According to various preferred embodiments, the nucleic acid of the invention encodes at least one antigenic peptide or protein from SARS-CoV-2 coronavirus as defined herein and, additionally, at least one heterologous peptide or protein element.

Suitably, the at least one heterologous peptide or protein element may promote or improve secretion of the encoded antigenic peptide or protein of the invention (e.g. via secretory signal sequences), promote or improve anchoring of the encoded antigenic peptide or protein of the invention in the plasma membrane (e.g. via transmembrane elements), promote or improve formation of antigen complexes (e.g. via multimerization domains or antigen clustering elements), or promote or improve virus-like particle formation (VLP forming sequence). In addition, the nucleic acid of the first aspect may additionally encode peptide linker elements, self-cleaving peptides, immunologic adjuvant sequences or dendritic cell targeting sequences.

Suitable multimerization domains may be selected from the list of amino acid sequences according to SEQ ID NOs: 1116-1167 of WO2017/081082, or fragments or variants of these sequences. Suitable transmembrane elements may be selected from the list of amino acid sequences according to SEQ ID NOs: 1228-1343 of WO2017/081082, or fragments or variants of these sequences. Suitable VLP forming sequences may be selected from the list of amino acid sequences according to SEQ ID NOs: 1168-1227 of the patent application WO2017/081082, or fragments or variants of these sequences. Suitable peptide linkers may be selected from the list of amino acid sequences according to SEQ ID NOs: 1509-1565 of the patent application WO2017/081082, or fragments or variants of these sequences. Suitable self-cleaving peptides may be selected from the list of amino acid sequences according to SEQ ID NOs: 1434-1508 of the patent application WO2017/081082, or fragments or variants of these sequences. Suitable immunologic adjuvant sequences may be selected from the list of amino acid sequences according to SEQ ID NOs: 1360-1421 of the patent application WO2017/081082, or fragments or variants of these sequences. Suitable dendritic cell (DCs) targeting sequences may be selected from the list of amino acid sequences according to SEQ ID NOs: 1344-1359 of the patent application WO2017/081082, or fragments or variants of these sequences. Suitable secretory signal peptides may be selected from the list of amino acid sequences according to SEQ ID NOs: 1-1115 and SEQ ID NO: 1728 of published PCT patent application WO2017/081082, or fragments or variants of these sequences In preferred embodiments, the at least one coding sequence additionally encodes one or more heterologous peptide or protein elements selected from a signal peptide, a linker peptide, a helper epitope, an antigen clustering element, a trimerization or multimerization element, a transmembrane element, or a VLP forming sequence.

In preferred embodiments, the nucleic acid of the invention encoding at least one antigenic protein derived from an SARS-CoV-2 coronavirus, additionally encodes at least one heterologous trimerization element, an antigen clustering element, or a VLP forming sequence.

Antigen Clustering Elements or Multimerization Elements

In preferred embodiments, the antigen clustering elements may be selected from a ferritin element, or a lumazine synthase element, surface antigen of Hepatitis B virus (HBsAg), or encapsulin. Expressing a stably clustered spike protein, preferably in in its prefusion conformation may increases the magnitude and breadth of neutralizing activity against SARS-CoV-2.

Lumazine synthase (Lumazine, LS, LumSynth) is an enzyme with particle-forming properties, present in a broad variety of organisms and involved in riboflavin biosynthesis.

In particularly preferred embodiments, lumazine synthase is used to promote antigen clustering and may therefore promote or enhance immune responses of the encoded coronavirus antigen of the invention.

In particularly preferred embodiments, the antigen clustering element (multimerization element) is or is derived from lumazine synthase, wherein the amino acid sequences of said antigen clustering domain is preferably identical or at least 70%, 80%, 85%, 86%, 87%, 88%, 89%, 90%, 91%, 92%, 93%, 94%, 95%, 96%, 97%, 98%, or 99% identical to any one of amino acid sequences SEQ ID NO: 112, a fragment or variant thereof.

Ferritin is a protein whose main function is intracellular iron storage. Almost all living organisms produce ferritin which is made of 24 subunits, each composed of a four-alpha-helix bundle, that self-assemble in a quaternary structure with octahedral symmetry. Its properties to self-assemble into nanoparticles are well-suited to carry and expose antigens.

In particularly preferred embodiments, ferritin is used to promote the antigen clustering and may therefore promote immune responses of the encoded coronavirus antigen, preferably spike protein.

In particularly preferred embodiments, the antigen clustering element (multimerization element) is or is derived from ferritin wherein the amino acid sequences of said antigen clustering domain is preferably identical or at least 70%, 80%, 85%, 86%, 87%, 88%, 89%, 90%, 91%, 92%, 93%, 94%, 95%, 96%, 97%, 98%, or 99% identical to any one of amino acid sequence SEQ ID NO: 113, a fragment or variant thereof.

In some embodiments, the antigen-clustering domain is a Hepatitis B surface antigen (HBsAg). HBsAg forms spherical particles. The addition of a fragment of the surface antigen of Hepatitis B virus (HBsAg) sequence may be particularly effective in enhancing the immune response of the nucleic-acid-based vaccine against coronavirus.

In particularly preferred embodiments, HBsAg is used to promote the antigen clustering and may therefore promote immune responses of the encoded coronavirus antigen, preferably a spike protein as defined herein.

In some embodiments, the antigen-clustering element is an encapsulin element. The addition of an encapsulin sequence may be particularly effective in enhancing the immune response of the nucleic-acid-based vaccine against coronavirus. In particularly preferred embodiments, encapsulin is used to promote the antigen clustering and may therefore promote immune responses of the encoded coronavirus antigen, preferably a spike protein as defined herein.

Encapsulin is a protein isolated from thermophile *Thermotoga maritima* and may be used as an element to allow self-assembly of antigens to form antigen (nano)particles. Encapsulin is assembled from 60 copies of identical 31 kDa monomers having a thin and icosahedral T=1 symmetric cage structure with interior and exterior diameters of 20 and 24 nm, respectively.

In some embodiments where the coding sequence of the nucleic acid additionally encodes heterologous antigen clustering element, it is particularly preferred and suitable to generate a fusion protein comprising an antigen-clustering element and an antigenic peptide or protein derived from SARS-CoV-2. Suitably, said antigenic peptide or protein, preferably the spike protein, is lacking the C-terminal transmembrane domain (TM) (lacking aa 1212 to aa 1273) or is lacking a part of the C-terminal transmembrane domain (TMflex), e.g. lacking aa 1148 to aa 1273.

Accordingly, any amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-26, 274-1278, 13521-13587, 22732, 22737-22758, 22929-22964 can be modified to remove the endogenous transmembrane domain (TM) at position aa 1212 to aa 1273 and may therefore be used as "C-terminally truncated" proteins in the context of the invention (Amino acid positions according to reference SEQ ID NO: 1). Furthermore, any amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-26, 274-1278, 13521-13587, 22732, 22737-22758, 22929-22964 can be modified to remove a part the endogenous transmembrane domain (TMflex) at position aa 1148 to aa 1273 and may therefore be used as "C-terminally truncated" proteins in the context of the invention (Amino acid positions according to reference SEQ ID NO: 1). Suitable spike proteins lacking the C-terminal transmembrane domain (TM or TMflex) may be selected from SEQ ID NOs: 31-39, 1614-3623, 13377-13510.

In other embodiments, where the coding sequence of the nucleic acid additionally encodes heterologous antigen clustering element as defined above, it is particularly preferred and suitable to generate a fusion protein comprising an antigen clustering element and an antigenic peptide or protein derived from SARS-CoV-2 spike protein fragment 51 (lacking S2 and/or TM and/or TMflex). Further, it may be suitable to use linker elements for separating the heterologous antigen-clustering element from the antigenic peptide or protein (e.g. a linker having the sequence GGS or a linker according to SEQ ID NO: 115 or 13152). The linker having the sequence GGS may be encoded by ggcgggagc (Linker GGS CDS gc), ggcgggagc (Linker GGS CDS human), or ggaggaucu (Linker GGS CDS gc mod).

In preferred embodiments, the at least one antigenic peptide or protein comprising a heterologous antigen clustering element comprises or consists of at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 58-75, 85-102, 3624-5633, 7644-9653, 13588-13721, 13856-13989, 22733, 22735, 22736 or an immunogenic fragment or immunogenic variant of any of these. Further information regarding said amino acid sequences is also provided in Table 1 (see rows 16 and 25 of Column A and B), and under <223> identifier of the ST25 sequence listing of respective sequence SEQ ID NOs.

Further suitable multimerization elements may be selected from the list of amino acid sequences according to SEQ ID NOs: 1116-1167 of WO2017/081082, or fragments or variants of these sequences. SEQ ID NOs: 1116-1167 of WO2017/081082 are herewith incorporated by reference.

Trimerization Elements

In preferred embodiments, the trimerization element may be selected from a foldon element. In preferred embodiments, the foldon element is a fibritin foldon element. Expressing a stable trimeric spike protein, preferably in its prefusion conformation, may increases the magnitude and breadth of neutralizing activity against SARS-CoV-2.

In particularly preferred embodiments, a fibritin foldon element is used to promote the antigen trimerization and may therefore promote immune responses of the encoded coronavirus antigen, preferably spike protein. Preferably, the foldon element is or is derived from a bacteriophage, preferably from bacteriophage T4, most preferably from fibritin of bacteriophage T4.

In particularly preferred embodiments, the trimerization element is or is derived from foldon wherein the amino acid sequences of said trimerization element is preferably identical or at least 70%, 80%, 85%, 86%, 87%, 88%, 89%, 90%, 91%, 92%, 93%, 94%, 95%, 96%, 97%, 98%, or 99% identical to any one of amino acid sequence SEQ ID NO: 114, a fragment or variant of any of these.

In other embodiments where the coding sequence of the nucleic acid additionally encodes heterologous trimerization element, it is particularly preferred and suitable to generate a fusion protein comprising a trimerization element and an antigenic peptide or protein derived from SARS-CoV-2. Suitably, said antigenic peptide or protein, preferably the spike protein derived from SARS-CoV-2 that is lacking the C-terminal transmembrane domain (lacking aa 1212 to aa 1273), or is lacking a part of the C-terminal transmembrane domain (TMflex), e.g. lacking aa 1148 to aa 1273.

Accordingly, any amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-26, 274-1278, 13521-13587, 22732, 22737-22758, 22947-22964 can be modified to lack the endogenous transmembrane element at position aa 1212 to aa 1273 and may therefore be used as "C-terminally truncated" proteins in the context of the invention. Furthermore, any amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-26, 274-1278, 13521-13587, 22732, 22737-22758, 22947-22964 can be modified to remove a part the endogenous transmembrane domain (TMflex) at position aa 1148 to aa 1273 and may therefore be used as "C-terminally truncated" proteins in the context of the invention (Amino acid positions according to reference SEQ ID NO: 1). Suitable spike proteins lacking the C-terminal transmembrane domain (TM or TMflex) may be selected from SEQ ID NOs: 31-39, 1614-3623, 13377-13510.

In other embodiments, where the coding sequence of the nucleic acid additionally encodes heterologous trimerization element as defined above, it is particularly preferred and suitable to generate a fusion protein comprising an trimerization element and an antigenic peptide or protein derived from SARS-CoV-2 spike protein fragment 51 (lacking S2 and/or TM and/or TMflex). Further, it may be suitable to use linker elements for separating the heterologous antigen-clustering element from the antigenic peptide or protein (e.g. a linker having the sequence GGS or a linker according to SEQ ID NO: 115 or 13152).

In preferred embodiments, the at least one antigenic peptide or protein comprising a heterologous trimerization element comprises or consists of at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 76-84, 103-111, 5634-6638, 9654-10658, 13722-13788, 13990-14056, 22734 or an immunogenic fragment or immunogenic variant of any of these. Further information regarding said amino acid sequences is also provided in Table 1 (see rows 26, 30, and 41 of Column A and B), and under <223> identifier of the ST25 sequence listing of respective sequence SEQ ID NOs.

Further suitable trimerization elements may be selected from the list of amino acid sequences according to SEQ ID NOs: 1116-1167 of WO2017/081082, or fragments or variants of these sequences. SEQ ID NOs: 1116-1167 of WO2017/081082 are herewith incorporated by reference.

VLP Forming Elements

In preferred embodiments, the VLP forming sequence may be selected and fused to the coronavirus antigen as defined herein. Expressing a stably clustered spike protein in VLP form may increases the magnitude and breadth of neutralizing activity against SARS-CoV-2. VLPs structurally mimic infectious viruses and they can induce potent cellular and humoral immune responses.

Suitable VLP forming sequences may be selected from elements derived from Hepatitis B virus core antigen, HIV-1 Gag protein, or Woodchuck hepatitis core antigen element (WhcAg).

In particularly preferred embodiments, the at least one VLP-forming sequence is a Woodchuck hepatitis core antigen element (WhcAg). The WhcAg element is used to promote VLP formation and may therefore promote immune responses of the encoded coronavirus antigen, preferably spike protein.

In particularly preferred embodiments, the VLP forming sequence is or is derived from foldon wherein the amino acid sequences of said VLP forming sequences is preferably identical or at least 70%, 80%, 85%, 86%, 87%, 88%, 89%, 90%, 91%, 92%, 93%, 94%, 95%, 96%, 97%, 98%, or 99% identical to any one of amino acid sequence SEQ ID NO: 13171, a fragment or variant of any of these.

In further embodiments where the coding sequence of the nucleic acid additionally encodes heterologous VLP forming sequence, it is particularly preferred and suitable to generate a fusion protein comprising a VLP forming sequence and an antigenic peptide or protein derived from SARS-CoV-2. Suitably, said antigenic peptide or protein, preferably the spike protein derived from SARS-CoV-2 that is lacking the C-terminal transmembrane domain (lacking aa 1212 to aa 1273), or is lacking a part of the C-terminal transmembrane domain (TMflex), e.g. lacking aa 1148 to aa 1273.

Accordingly, any amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-26, 274-1278, 13521-13587, 22732, 22737-22758, 22929-22964 can be modified to lack the endogenous transmembrane element at position aa 1212 to aa 1273 and may therefore be used as "C-terminally truncated" proteins in the context of the invention. Furthermore, any amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-26, 274-1278, 13521-13587, 22732, 22737-22758, 22929-22964 can be modified to remove a part the endogenous transmembrane domain (TMflex) at position aa 1148 to aa 1273 and may therefore be used as "C-terminally truncated" proteins in the context of the invention (Amino acid positions according to reference SEQ ID NO: 1). Suitable spike proteins lacking the C-terminal transmembrane domain (TM or TMflex) may be selected from SEQ ID NOs: 31-39, 1614-3623, 13377-13510.

In other embodiments, where the coding sequence of the nucleic acid additionally encodes heterologous VLP-forming sequence as defined above, it is particularly preferred and suitable to generate a fusion protein comprising a VLP-forming sequence and an antigenic peptide or protein derived from SARS-CoV-2 spike protein fragment S1 (lacking S2 and/or TM and/or TMflex). Further, it may be suitable to use linker elements for separating the heterologous antigen-clustering element from the antigenic peptide or protein (e.g. a linker having the sequence GGS or a linker according to SEQ ID NO: 115 or 13152).

In preferred embodiments, the at least one antigenic peptide or protein comprising a heterologous VLP-forming sequence comprises or consists of at least one of the amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 6639-7643, 10659-11663, 13789-13855, 14057-14123 or an immunogenic fragment or immunogenic variant of any of these. Further information regarding said amino acid sequences is also provided in Table 1 (see rows 31 and 35 of Column A and B), and under <223> identifier of the ST25 sequence listing of respective sequence SEQ ID NOs.

Further suitable VLP forming sequences in that context may be selected from the list of amino acid sequences according to SEQ ID NOs: 1168-1227 of the patent application WO2017/081082, or fragments or variants of these sequences. SEQ ID NOs: 1168-1227 of WO2017/081082 are herewith incorporated by reference.

Heterologous Secretory Signal Peptides

In some embodiments, the antigenic peptide or protein comprises a heterologous signal peptide. A heterologous signal peptide may be used to improve the secretion of the encoded coronavirus antigen.

Suitable secretory signal peptides may be selected from the list of amino acid sequences according to SEQ ID NOs: 1-1115 and SEQ ID NO: 1728 of published PCT patent application WO2017/081082, or fragments or variants of these sequences. 1-1115 and SEQ ID NO: 1728 of WO2017/081082 are herewith incorporated by reference. In embodiments where the coding sequence of the nucleic acid additionally encodes heterologous secretory signal peptide, it is particularly preferred and suitable to generate a fusion protein comprising a heterologous secretory signal peptide and an antigenic peptide or protein derived from SARS-CoV-2. Suitably, said antigenic peptide or protein, preferably the spike protein derived from SARS-CoV-2 is lacking the N-terminal endogenous secretory signal peptide (lacking aa 1 to aa 15). Accordingly, any amino acid sequences being identical or at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NOs: 1-26, 274-1278, 13521-13587, 22732, 22737-22758, 22929-22964 can be modified to lack the endogenous secretory signal peptide at position aa 1 to aa 15 and may therefore be used as "N-terminally truncated" proteins in the context of the invention.

In the following List 1, suitable SARS-CoV-2 coronavirus antigenic peptides and proteins as defined above are further specified in detail (e.g. nomenclature, protein elements, etc.).

List 1: Exemplary Suitable Protein Designs of the Invention:

Full length spike protein (S) comprising aa 1 to aa 1273;
see for example SEQ ID NO: 1, 274.
Stabilized S protein comprising aa1-aa1273 and K986P, V987P substitutions (S_stab_PP);
see for example SEQ ID NO: 10, 341.
Stabilized S protein comprising aa1-aa1273 and K986P, V987P substitutions (S_stab_PP);
see for example SEQ ID NO: 22961.
Stabilized S protein comprising aa1-aa1273 and K986P, V987P substitutions (S_stab_PP);
see for example SEQ ID NO: 22960.
Stabilized S protein comprising aa1-aa1273 and K986P, V987P, F817P, A892P, A899P, A942P proline substitutions; S_stab_PP_hex
see for example SEQ ID NO: 22732.
Stabilized S protein comprising aa1-aa1273 and K986P, V987P substitutions and a cavity filling mutation (T887W, A1020W); S_stab_PP_cav
see for example SEQ ID NO: 408.
Stabilized S protein comprising aa1-aa1273 and K986P, V987P substitutions and a cavity filling mutation (P1069F); S_stab_PP_cav
see for example SEQ ID NO: 475.
Stabilized S protein comprising aa1-aa1273 and K986P, V987P substitutions and a cavity filling mutation (H1048Q, H1064N, H1083N, H1101N); S_stab_PP_prot
see for example SEQ ID NO: 542.
Stabilized S protein comprising aa1-aa1273 and an artificial disulfide bond (S_stab_disul) 17120, T1077C;
see for example SEQ ID NO: 19, 609.
S without transmembrane domain comprising aa1-aa1211 (S_woTM);
see for example SEQ ID NO: 31, 1614.
S without transmembrane domain flex comprising aa1-aa1147 (S_woTMflex);
see for example SEQ ID NO: 2619.
S_woTM comprising K986P, V987P substitutions (S_stab_PP_woTM)
see for example SEQ ID NO: 40, 1681.
S_woTMflex comprising K986P, V987P substitutions (S_stab_PP_woTMflex)
see for example SEQ ID NO: 2686.
Spike protein fragment S1 comprising aa 1 to aa 681 (S1);
see for example SEQ ID NO: 27, 1279.
S_woTM comprising a lumazine synthase;
see for example SEQ ID NO: 58, 3624.
S_woTMflex comprising a lumazine synthase;
see for example SEQ ID NO: 7644.
S_stab_PP_woTM comprising a lumazine synthase;
see for example SEQ ID NO: 85, 3691.
S_stab_PP_woTMflex comprising a lumazine synthase;
see for example SEQ ID NO: 7711.
S_woTM comprising a ferritin element;
see for example SEQ ID NO: 67, 4629.
S_woTMflex comprising a ferritin element;
see for example SEQ ID NO: 8649.
S_stab_PP_woTM comprising a ferritin element;
see for example SEQ ID NO: 94, 4696.
S_stab_PP_woTMflex comprising a ferritin element;
see for example SEQ ID NO: 8716.
S_woTM comprising a foldon element;
see for example SEQ ID NO: 76, 5634.
S_woTMflex comprising a foldon element;
see for example SEQ ID NO: 9654.
S_stab_PP_woTM comprising a foldon element;
see for example SEQ ID NO: 103, 5701.
S_stab_PP_woTMflex comprising a foldon element;
see for example SEQ ID NO: 9721.
S_woTM comprising a VLP-sequence (WhcAg);
see for example SEQ ID NO: 6639.
S_woTMflex comprising a VLP-sequence (WhcAg);
see for example SEQ ID NO 10659.

S_stab_PP_woTM comprising a VLP-sequence (WhcAg);
see for example SEQ ID NO: 6706.
S_stab_PP_woTMflex comprising a VLP-sequence (WhcAg);
see for example SEQ ID NO: 10726.
truncRBD comprising a foldon element:
see for example SEQ ID NO: 22734.
truncRBD comprising a lumazine synthase (C-terminal)
see for example SEQ ID NO: 22735.
truncRBD comprising a lumazine synthase (N-terminal)
see for example SEQ ID NO: 22736
truncRBD comprising a ferritin element:
see for example SEQ ID NO: 22733.
Amino acid positions provided in List 1 are according to reference SEQ ID NO: 1.

In particularly preferred embodiments of the first aspect, the at least one antigenic peptide or protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10, 21, 22, 25, 27, 274, 341, 408, 475, 542, 743, 810, 1011, 1145, 1212, 1279, 8716, 10726, 22732-22758, 22929-22942, 22947-22964 or an immunogenic fragment or immunogenic variant of any of these.

Preferred antigenic peptide or proteins derived from an SARS-CoV-2 coronavirus as defined above are provided in Table 1 (rows 1 to 41). Therein, each row 1 to 41 corresponds to a suitable SARS-CoV-2 coronavirus constructs. Column A of Table 1 provides a short description of suitable antigen constructs. Column B of Table 1 provides protein (amino acid) SEQ ID NOs of respective antigen constructs. Column C of Table 1 provides SEQ ID NO of the corresponding wild type nucleic acid coding sequences. Column D of Table 1 provides SEQ ID NO of the corresponding G/C optimized nucleic acid coding sequences (opt1, gc). Column E of Table 1 provides SEQ ID NO of the corresponding human codon usage adapted nucleic acid coding sequences (opt 3, human). Column F of Table 1 provides SEQ ID NO of the corresponding G/C content modified nucleic acid coding sequences (opt10, gc mod) (for a detailed description of "coding sequences", see paragraph "suitable coding sequences").

Notably, the description of the invention explicitly includes the information provided under <223> identifier of the ST25 sequence listing of the present application. Preferred nucleic acid constructs comprising coding sequences of Table 1, e.g. mRNA sequences comprising the coding sequences of Table 1 are provided in Table 3a and Table 3b.

TABLE 1

Preferred coronavirus constructs (amino acid sequences and nucleic acid coding sequences):

| row | A | B | C | D | E | F |
|---|---|---|---|---|---|---|
| 1 | Full-length spike protein; S | 1-9, 274-340, 22737, 22739, 22741, 22743, 22745, 22747, 22749, 22751, 22753, 22755, 22757; 22929-22946 | 116-131, 11664-11730 | 136, 11731-11797, 22764, 22766, 22768, 22770, 22772, 22774, 22776, 22778, 22780, 22782, 22784; 22969-23040 | 11967-12033 | 12034; 23041-23076 |
| 2 | Stabilized spike protein; S_stab_PP | 10-18, 341-407, 22738, 22740, 22742, 22744, 22746, 22748, 22750, 22752, 22754, 22756, 22758; 22947-22964 | | 137, 11798, 22765, 22767, 22769, 22771, 22773, 22775, 22777, 22779, 22781, 22783, 22785; 23077-23148 | 142 | 146, 12035; 23149-23184 |
| 3 | Stabilized spike protein; S_stab_PP_cav | 408-541 | | 11799, 11800 | | 12036, 12037 |
| 4 | Stabilized spike protein; S_stab_PP_prot | 542-608 | | 11801 | | 12038 |
| 5 | Stabilized spike protein; S_stab_disul | 19-26, 609-1278, 13521-13587 | | 11802-11811, 14124 | | 12039-12048, 14133 |
| 6 | Spike protein fragment S1 | 27, 1279-1345 | 132 | 138, 11812 | 143 | 147, 12049 |
| 7 | Spike protein fragment S2 | 30, 1346-1412 | 135 | 141, 11813 | | 12050 |
| 8 | Signal peptide of spike protein; SP | 28, 1413-1479 | 133 | 139, 11814 | 144 | 12051 |
| 9 | S1 without signal peptide; S1_woSP | 29, 1480-1546 | 134 | 140, 11815 | 145 | 12052 |
| 10 | Transmembrane domain of spike protein; TM/TMflex | 49-57, 1547-1613, 13176-13242 | | 11816, 13511 | | 12053, 13516 |
| 11 | S without transmembrane domain; S_woTM/woTMflex | 31-39, 1614-1680, 2619-2685 | | 11817, 11832 | | 12054, 12069 |
| 12 | Stabilized S without transmembrane domain; S_stab_PP_woTM/woTMflex | 40-48, 1681-1747, 2686-2752 | | 11818, 11833 | | 12055, 12070 |
| 13 | Stabilized S without transmembrane domain; S_stab_PP_cav_woTM/woTMflex | 1748-1881, 2753-2886 | | 11819, 11820, 11834, 11835 | | 12056, 12057, 12071, 12072 |

TABLE 1-continued

Preferred coronavirus constructs (amino acid sequences and nucleic acid coding sequences):

| row | A | B | C | D | E | F |
|---|---|---|---|---|---|---|
| 14 | Stabilized S without transmembrane domain; S_stab_PP_prot_woTM/ woTMflex | 1882-1948, 2887-2953 | | 11821, 11836 | | 12058, 12073 |
| 15 | Stabilized S without transmembrane domain; S_stab_disul_woTM/woTMflex | 1949-2618, 2954-3623, 13377-13510 | | 11822-11831, 11837-11846, 13514, 13515 | | 12059-12068, 12074-12083, 13519, 13520 |
| 16 | S_woTM/woTMflex comprising a lumazine synthase | 58-66, 3624-3690, 7644-7710 | | 11847, 11907 | | 12084, 12144 |
| 17 | S_stab_PP_woTM/woTMflex comprising a lumazine synthase | 85-93, 3691-3757, 7711-7777 | | 11848, 11908 | | 12085, 12145 |
| 18 | S_stab_PP_cav_woTM/ woTMflex comprising a lumazine synthase | 3758-3891, 7778-7911 | | 11849, 11850, 11909, 11910 | | 12086, 12087, 12146, 12147 |
| 19 | S_stab_PP_prot_woTM/ woTMflex comprising a lumazine synthase | 3892-3958, 7912-7978 | | 11851, 11911 | | 12088, 12148 |
| 20 | S_stab_disul_woTM/woTMflex comprising a lumazine synthase | 3959-4628, 7979-8648, 13588-13654, 13856-13922 | | 11852-11861, 11912-11921, 14125, 14129 | | 12089-12098, 12149-12158, 14134, 14138 |
| 21 | S_woTM/woTMflex comprising a ferritin | 67-75, 4629-4695, 8649-8715 | | 11862, 11922 | | 12099, 12159 |
| 22 | S_stab_PP_woTM/woTMflex comprising a ferritin | 94-102, 4696-4762, 8716-8782 | | 11863, 11923 | | 12100, 12160 |
| 23 | S_stab_PP_cav_woTM/ woTMflex comprising a ferritin | 4763-4896, 8783-8916 | | 11864, 11865, 11924, 11925 | | 12101, 12102, 12161, 12162 |
| 24 | S_stab_PP_prot_woTM/ woTMflex comprising a ferritin | 4897-4963, 8917-8983 | | 11866, 11926 | | 12103, 12163 |
| 25 | S_stab_disul_woTM/woTMflex comprising a ferritin | 4964-5633, 8984-9653, 13655-13721, 13923-13989 | | 11867-11876, 11927-11936, 14126, 14130 | | 12104-12113, 12164-12173, 14135, 14139 |
| 26 | S_woTM/woTMflex comprising a foldon | 76-84, 5634-5700, 9654-9720 | | 11877, 11937 | | 12114, 12174 |
| 27 | S_stab_ PP_woTM/woTMflex comprising a foldon | 103-111, 5701-5767, 9721-9787 | | 11878, 11938 | | 12115, 12175 |
| 28 | S_stab_PP_cav_woTM/ woTMflex comprising a foldon | 5768-5901, 9788-9921 | | 11879, 11880, 11939, 11940 | | 12116, 12117, 12176, 12177 |
| 29 | S_stab_PP_prot_woTM/ woTMflex comprising a foldon | 5902-5968, 9922-9988 | | 11881, 11941 | | 12118, 12178 |
| 30 | S_stab_disul_woTM/woTMflex comprising a foldon | 5969-6638, 9989-10658, 13722-13788, 13990-14056 | | 11882-11891, 11942-11951, 14127, 14131 | | 12119-12128, 12179-12188, 14136, 14140 |
| 31 | S_woTM/woTMflex comprising a WhcAg (VLP) | 6639-6705, 10659-10725 | | 11892, 11952 | | 12129, 12189 |
| 32 | S_stab_PP_woTM/woTMflex comprising a WhcAg (VLP) | 6706-6772, 10726-10792 | | 11893, 11953 | | 12130, 12190 |
| 33 | S_stab_PP_cav_woTM/ woTMflex comprising a WhcAg (VLP) | 6773-6906, 10793-10926 | | 11894, 11895, 11954, 11955 | | 12131, 12132, 12191, 12192 |
| 34 | S_stab_PP_prot_woTM/ woTMflex comprising a WhcAg (VLP) | 6907-6973, 10927-10993 | | 11896, 11956 | | 12133, 12193 |
| 35 | S_stab_disul_woTM/woTMflex comprising a WhcAg (VLP) | 6974-7643, 10994-11663, 13789-13855, 14057-14123 | | 11897-11906, 11957-11966, 14128, 14132 | | 12134-12143, 12194-12203, 14137, 14141 |
| 36 | Receptor binding domain; RBD | 13243-13309, 22917, 22923 | | 13512, 22914, 22918, 22919, 22924, 22925 | | 13517, 22915, 22916, 22920-22922, 22926-22928 |
| 37 | Critical neutralisation domain; CND | 13310-13376 | | 13513 | | 13518 |
| 38 | Stabilized spike protein; S_stab_PP_hex | 22732 | | 22759 | | |
| 39 | RBD comprising a lumazyne synthase | 22735, 22736 | | 22762, 22763, 22967, 22968 | | |

TABLE 1-continued

| Preferred coronavirus constructs (amino acid sequences and nucleic acid coding sequences): | | | | | | |
|---|---|---|---|---|---|---|
| row | A | B | C | D | E | F |
| 40 | RBD comprising a ferritin | 22733 | | 22760, 22965 | | |
| 41 | RBD comprising a foldon | 22734, 26938, 26939 | | 22761, 22966, 26940, 26941 | | |

Suitable Coding Sequences:

According to preferred embodiments, the nucleic acid of the invention comprises at least one coding sequence encoding at least one antigenic peptide or protein derived from SARS-CoV-2 (nCoV-2019) coronavirus, preferably as defined above, or fragments and variants thereof. In that context, any coding sequence encoding at least one antigenic protein as defined herein, or fragments and variants thereof may be understood as suitable coding sequence and may therefore be comprised in the nucleic acid of the invention.

In preferred embodiments, the nucleic acid of the first aspect may comprise or consist of at least one coding sequence encoding at least one antigenic peptide or protein from SARS-CoV-2 coronavirus as defined herein, preferably encoding any one of SEQ ID NOs: 1-111, 274-11663, 13176-13510, 13521-14123, 22732-22758, 22917, 22923, 22929-22964, 26938, 26939 or fragments of variants thereof. It has to be understood that, on nucleic acid level, any sequence (DNA or RNA sequence) which encodes an amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1-111, 274-11663, 13176-13510, 13521-14123, 22732-22758, 22917, 22923, 22929-22964, 26938, 26939 or fragments or variants thereof, may be selected and may accordingly be understood as suitable coding sequence of the invention. Further information regarding said amino acid sequences is also provided in Table 1 (see rows 1 to 41 of Column A and B), Table 3a and 3b, and under <223> identifier of the ST25 sequence listing of respective sequence SEQ ID NOs.

In preferred embodiments, the nucleic acid of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to the sequences according to SEQ ID NOs: 116-132, 134-138, 140-143, 145-175, 11664-11813, 11815, 11817-12050, 12052, 12054-13147, 13514, 13515, 13519, 13520, 14124-14177, 22759, 22764-22786, 22791-22813, 22818-22839, 22969-23184, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 or a fragment or a fragment or variant of any of these sequences. Further information regarding said nucleic acid sequences is also provided in Table 1 (see rows 1 to 7, 9, 11-41 of Column C-F), Table 3a and 3b, and under <223> identifier of the ST25 sequence listing of respective sequence SEQ ID NOs.

Alternatively, the nucleic acid of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to the sequences according SEQ ID NOs: 116-132, 134-138, 140-143, 145-175, 11664-11813, 11815, 11817-12050, 12052, 12054-13147, 13514, 13515, 13519, 13520, 14124-14177, 22759, 22764-22786, 22791-22813, 22818-22839, 22969-23184, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 wherein all Uracils (U) in the respective sequences are substituted by Thymidines (T), or a fragment or a fragment or variant of any of these sequences. Further information regarding said nucleic acid sequences is also provided in Table 1 (see rows 1 to 7, 9, 11-41 of Column C-F), Table 3a and 3b, and under <223> identifier of the ST25 sequence listing of respective sequence SEQ ID NOs.

In preferred embodiments, the nucleic acid of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to the sequences according to SEQ ID NOs: 116-132, 134-138, 140-143, 145-175, 11664-11813, 11815, 11817-12050, 12052, 12054-12203, 13514, 13515, 13519, 13520, 14124-14141, 22759, 22764-22785, 22969-23184 or a fragment or a fragment or variant of any of these sequences. Further information regarding said nucleic acid sequences is also provided in Table 1 (see rows 1 to 7, 9, 11-41 of Column C-F), Table 3a and 3b, and under <223> identifier of the ST25 sequence listing of respective sequence SEQ ID NOs.

Alternatively, the nucleic acid of the first aspect comprises a coding sequence that comprises at least one of the nucleic acid sequences being identical or at least 70%, 80%, 85%, 86%, 87%, 88%, 89%, 90%, 91%, 92%, 93%, 94%, 95%, 96%, 97%, 98%, or 99% identical to the sequences according SEQ ID NOs: 116-132, 134-138, 140-143, 145-175, 11664-11813, 11815, 11817-12050, 12052, 12054-12203, 13514, 13515, 13519, 13520, 14124-14141, 22759, 22764-22785, 22969-23184 wherein all Uracils (U) in the respective sequences are substituted by Thymidines (T), or a fragment or a fragment or variant of any of these sequences. Further information regarding said nucleic acid sequences is also provided in Table 1 (see rows 1 to 7, 9, 11-41 of Column C-F), Table 3a and 3b, and under <223> identifier of the ST25 sequence listing of respective sequence SEQ ID NOs.

In preferred embodiments, the nucleic acid of the first aspect is an artificial nucleic acid, e.g. an artificial DNA or an artificial RNA.

The term "artificial nucleic acid" as used herein is intended to refer to a nucleic acid that does not occur naturally. In other words, an artificial nucleic acid may be understood as a non-natural nucleic acid molecule. Such nucleic acid molecules may be non-natural due to its individual sequence (e.g. G/C content modified coding sequence, UTRs) and/or due to other modifications, e.g. structural modifications of nucleotides. Typically, artificial nucleic acid may be designed and/or generated by genetic engineering to correspond to a desired artificial sequence of nucleotides. In this context, an artificial nucleic acid is a sequence that may not occur naturally, i.e. a sequence that differs from the wild type sequence/the naturally occurring sequence by at least one nucleotide. The term "artificial nucleic acid" is not restricted to mean "one single molecule" but is understood to comprise an ensemble of essentially identical nucleic acid molecules. Accordingly, it may relate to a plurality of essentially identical nucleic acid molecules. The term "artificial nucleic acid" as used herein may relate to an artificial DNA or, preferably, to an artificial RNA.

In preferred embodiments, the nucleic acid, preferably the DNA or RNA of the first aspect is a modified and/or stabilized nucleic acid, preferably a modified and/or stabilized artificial nucleic acid.

According to preferred embodiments, the nucleic acid of the present invention may thus be provided as a "stabilized artificial nucleic acid" or "stabilized coding nucleic acid" that is to say a nucleic acid showing improved resistance to in vivo degradation and/or a nucleic acid showing improved stability in vivo, and/or a nucleic acid showing improved translatability in vivo. In the following, specific suitable modifications/adaptations in this context are described which are suitably to "stabilize" the nucleic acid. Preferably, the nucleic acid of the present invention may be provided as a "stabilized RNA", "stabilized coding RNA", "stabilized DNA" or "stabilized coding DNA".

Such stabilization may be effected by providing a "dried nucleic acid" (e.g. a dried DNA or RNA) and/or a "purified nucleic acid" (e.g. a purified DNA or RNA) as specified herein. Alternatively or in addition to that, such stabilization can be effected, for example, by a modified phosphate backbone of the nucleic acid of the present invention. A backbone modification in connection with the present invention is a modification in which phosphates of the backbone of the nucleotides contained in the nucleic acid are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized nucleic acids, preferably stabilized RNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, suitable modifications are described that are capable of "stabilizing" the nucleic acid of the invention.

In preferred embodiments, the nucleic acid, e.g. the RNA or DNA, comprises at least one codon modified coding sequence.

In preferred embodiments, the at least one coding sequence of the nucleic acid is a codon modified coding sequence, wherein the amino acid sequence encoded by the at least one codon modified coding sequence is preferably not being modified compared to the amino acid sequence encoded by the corresponding wild type or reference coding sequence.

The term "codon modified coding sequence" relates to coding sequences that differ in at least one codon (triplets of nucleotides coding for one amino acid) compared to the corresponding wild type or reference coding sequence. Suitably, a codon modified coding sequence in the context of the invention may show improved resistance to in vivo degradation and/or improved stability in vivo, and/or improved translatability in vivo. Codon modifications in the broadest sense make use of the degeneracy of the genetic code wherein multiple codons may encode the same amino acid and may be used interchangeably (cf. Table 2) to optimize/modify the coding sequence for in vivo applications as outlined above.

The term "reference coding sequence" relates to the coding sequence, which was the origin sequence to be modified and/or optimized.

In preferred embodiments, the at least one coding sequence of the nucleic acid is a codon modified coding sequence, wherein the codon modified coding sequence is selected from C maximized coding sequence, CAI maximized coding sequence, human codon usage adapted coding sequence, G/C content modified coding sequence, and G/C optimized coding sequence, or any combination thereof.

When transfected into mammalian host cells, the nucleic acid comprising a codon modified coding sequence has a stability of between 12-18 hours, or greater than 18 hours, e.g., 24, 36, 48, 60, 72, or greater than 72 hours and are capable of being expressed by the mammalian host cell (e.g. a muscle cell).

When transfected into mammalian host cells, the nucleic acid comprising a codon modified coding sequence is translated into protein, wherein the amount of protein is at least comparable to, or preferably at least 10% more than, or at least 20% more than, or at least 30% more than, or at least 40% more than, or at least 50% more than, or at least 100% more than, or at least 200% or more than the amount of protein obtained by a naturally occurring or wild type or reference coding sequence transfected into mammalian host cells.

In preferred embodiments, the nucleic acid of the invention may be modified, wherein the C content of the at least one coding sequence may be increased, preferably maximized, compared to the C content of the corresponding wild type or reference coding sequence (herein referred to as "C maximized coding sequence"). The amino acid sequence encoded by the C maximized coding sequence of the nucleic acid is preferably not modified compared to the amino acid sequence encoded by the respective wild type or reference coding sequence. The generation of a C maximized nucleic acid sequences may suitably be carried out using a modification method according to WO2015/062738. In this context, the disclosure of WO2015/062738 is included herewith by reference.

In preferred embodiments, the nucleic acid may be modified, wherein the G/C content of the at least one coding sequence may be optimized compared to the G/C content of the corresponding wild type or reference coding sequence (herein referred to as "G/C content optimized coding sequence"). "Optimized" in that context refers to a coding sequence wherein the G/C content is preferably increased to the essentially highest possible G/C content. The amino acid sequence encoded by the G/C content optimized coding sequence of the nucleic acid is preferably not modified as compared to the amino acid sequence encoded by the respective wild type or reference coding sequence. The generation of a G/C content optimized nucleic acid sequence (RNA or DNA) may be carried out using a method according to WO2002/098443. In this context, the disclosure of WO2002/098443 is included in its full scope in the present invention. Throughout the description, including the <223> identifier of the sequence listing, G/C optimized coding sequences are indicated by the abbreviations "opt1" or "gc".

In preferred embodiments, the nucleic acid may be modified, wherein the codons in the at least one coding sequence may be adapted to human codon usage (herein referred to as "human codon usage adapted coding sequence"). Codons encoding the same amino acid occur at different frequencies in humans. Accordingly, the coding sequence of the nucleic acid is preferably modified such that the frequency of the codons encoding the same amino acid corresponds to the naturally occurring frequency of that codon according to the human codon usage. For example, in the case of the amino acid Ala, the wild type or reference coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 2). Accordingly, such a procedure (as exemplified for Ala) is applied for each amino acid encoded by the coding sequence of the nucleic acid to obtain sequences adapted to human codon usage. Throughout the description, including the <223> identifier of the sequence listing, human codon usage adapted coding sequences are indicated by the abbreviation "opt3" or "human".

TABLE 2

Human codon usage table with frequencies indicated for each amino acid

| Amino acid | codon | frequency | Amino acid | codon | frequency |
| --- | --- | --- | --- | --- | --- |
| Ala | GCG | 0.10 | Pro | CCG | 0.11 |
| Ala | GCA | 0.22 | Pro | CCA | 0.27 |
| Ala | GCT | 0.28 | Pro | CCT | 0.29 |
| Ala | GCC* | 0.40 | Pro | CCC* | 0.33 |
| Cys | TGT | 0.42 | Gln | CAG* | 0.73 |
| Cys | TGC* | 0.58 | Gln | CAA | 0.27 |
| Asp | GAT | 0.44 | Arg | AGG | 0.22 |
| Asp | GAC* | 0.56 | Arg | AGA* | 0.21 |
| Glu | GAG* | 0.59 | Arg | CGG | 0.19 |
| Glu | GAA | 0.41 | Arg | CGA | 0.10 |
| Phe | TTT | 0.43 | Arg | CGT | 0.09 |
| Phe | TTC* | 0.57 | Arg | CGC | 0.19 |
| Gly | GGG | 0.23 | Ser | AGT | 0.14 |
| Gly | GGA | 0.26 | Ser | AGC* | 0.25 |
| Gly | GGT | 0.18 | Ser | TCG | 0.06 |
| Gly | GGC* | 0.33 | Ser | TCA | 0.15 |
| His | CAT | 0.41 | Ser | TCT | 0.18 |
| His | CAC* | 0.59 | Ser | TCC | 0.23 |
| Ile | ATA | 0.14 | Thr | ACG | 0.12 |
| Ile | ATT | 0.35 | Thr | ACA | 0.27 |
| Ile | ATC* | 0.52 | Thr | ACT | 0.23 |
| Lys | AAG* | 0.60 | Thr | ACC* | 0.38 |
| Lys | AAA | 0.40 | Val | GTG* | 0.48 |
| Leu | TTG | 0.12 | Val | GTA | 0.10 |
| Leu | TTA | 0.06 | Val | GTT | 0.17 |
| Leu | CTG* | 0.43 | Val | GTC | 0.25 |
| Leu | CTA | 0.07 | Trp | TGG* | 1 |
| Leu | CTT | 0.12 | Tyr | TAT | 0.42 |
| Leu | CTC | 0.20 | Tyr | TAC* | 0.58 |
| Met | ATG* | 1 | Stop | TGA* | 0.61 |
| Asn | AAT | 0.44 | Stop | TAG | 0.17 |
| Asn | AAC* | 0.56 | Stop | TAA | 0.22 |

*most frequent human codon

In embodiments, the nucleic acid of the invention may be modified, wherein the G/C content of the at least one coding sequence may be modified compared to the G/C content of the corresponding wild type or reference coding sequence (herein referred to as "G/C content modified coding sequence"). In this context, the terms "G/C optimization" or "G/C content modification" relate to a nucleic acid that comprises a modified, preferably an increased number of guanosine and/or cytosine nucleotides as compared to the corresponding wild type or reference coding sequence. Such an increased number may be generated by substitution of codons containing adenosine or thymidine nucleotides by codons containing guanosine or cytosine nucleotides. Advantageously, nucleic acid sequences having an increased G/C content are more stable or show a better expression than sequences having an increased A/U. The amino acid sequence encoded by the G/C content modified coding sequence of the nucleic acid is preferably not modified as compared to the amino acid sequence encoded by the respective wild type or reference sequence. Preferably, the G/C content of the coding sequence of the nucleic acid is increased by at least 10%, 20%, 30%, preferably by at least 40% compared to the G/C content of the coding sequence of the corresponding wild type or reference nucleic acid sequence (herein referred to "opt 10" or "gc mod").

In embodiments, the nucleic acid may be modified, wherein the codon adaptation index (CAI) may be increased or preferably maximised in the at least one coding sequence (herein referred to as "CAI maximized coding sequence"). It is preferred that all codons of the wild type or reference nucleic acid sequence that are relatively rare in e.g. a human are exchanged for a respective codon that is frequent in the e.g. a human, wherein the frequent codon encodes the same amino acid as the relatively rare codon. Suitably, the most frequent codons are used for each amino acid of the encoded protein (see Table 2, most frequent human codons are marked with asterisks). Suitably, the nucleic acid comprises at least one coding sequence, wherein the codon adaptation index (CAI) of the at least one coding sequence is at least 0.5, at least 0.8, at least 0.9 or at least 0.95. Most preferably, the codon adaptation index (CAI) of the at least one coding sequence is 1 (CAI=1). For example, in the case of the amino acid Ala, the wild type or reference coding sequence may be adapted in a way that the most frequent human codon "GCC" is always used for said amino acid. Accordingly, such a procedure (as exemplified for Ala) may be applied for each amino acid encoded by the coding sequence of the nucleic acid to obtain CAI maximized coding sequences.

In particularly preferred embodiments, the at least one coding sequence of the nucleic acid is a codon modified coding sequence, wherein the codon modified coding sequence is selected a G/C optimized coding sequence, a human codon usage adapted coding sequence, or a G/C modified coding sequence.

In preferred embodiments, the nucleic acid of the first aspect comprises at least one coding sequence comprising or consisting a codon modified nucleic acid sequence which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 136-138, 140-143, 145-175, 11731-11813, 11815, 11817-12050, 12052, 12054-13147, 14142-14177, 22759, 22764-22786, 22791-22813, 22818-22839, 22969-23184, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 or a fragment or variant of any of these sequences. Additional information regarding each of these suitable nucleic acid sequences encoding may also be derived from the sequence listing, in particular from the details provided therein under identifier <223>. Suitable coding sequences of the first aspect are provided in Table 1. Further information regarding said nucleic acid sequences is also provided in Table 1 (see rows 1 to 7, 9, 11-41 of Column D-F), Table 3a and 3b, and under <223> identifier of the ST25 sequence listing of respective sequence SEQ ID NOs.

Alternatively, the nucleic acid of the first aspect comprises at least one coding sequence comprising or consisting a codon modified nucleic acid sequence which is identical or at least 70%, 80%, 85%, 86%, 87%, 88%, 89%, 90%, 91%, 92%, 93%, 94%, 95%, 96%, 97%, 98%, or 99% identical to the sequences according to SEQ ID NOs: 136-138, 140-143, 145-175, 11731-11813, 11815, 11817-12050, 12052, 12054-13147, 14142-14177, 22759, 22764-22786, 22791-22813, 22818-22839, 22969-23184, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 wherein all Uracils (U) in the respective sequences are substituted by Thymidines (T), or a fragment or a fragment or variant of any of these sequences. Further information regarding said nucleic acid sequences is also provided in Table 1 (see rows 1 to 7, 9, 11-41 of Column D-F), Table 3a and 3b, and under <223> identifier of the ST25 sequence listing of respective sequence SEQ ID NOs.

In particularly preferred embodiments, the nucleic acid of the first aspect comprises at least one coding sequence comprising or consisting a G/C optimized coding sequence which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 136-138, 140, 141, 148, 149, 152, 155, 156, 159, 162, 163, 166, 169, 170, 173, 11731-11813, 11815, 11817-11966, 12271-12472, 12743-12944, 13514, 13515, 14124-14132, 14142-14150, 14160-14168, 22759, 22764-22786, 22791-22813, 22818-22839, 22969-23040, 23077-23148, 23189-23260, 23297-23368, 23409-23480, 23517-23588, 23629-23700, 23737-23808, 23849-23920, 23957-24028, 24069-24140, 24177-24248, 24289-24360, 24397-24468, 24509-24580, 24617-24688, 24729-24800, 24837-24908, 24949-25020, 25057-25128, 25169-25240, 25277-25348, 25389-25460, 25497-25568, 25609-25680, 25717-25788, 25829-25900, 25937-26008, 26049-26120, 26157-26228, 26269-26340, 26377-26448, 26489-26560, 26597-26668, 26709-26780, 26817-26888, 26925-26937 or a fragment or variant of any of these sequences. Additional information regarding each of these suitable nucleic acid sequences encoding may also be derived from the sequence listing, in particular from the details provided therein under identifier <223>. Suitable coding sequences of the first aspect are provided in Table 1. Further information regarding said nucleic acid sequences is also provided in Table 1 (see rows 1 to 7, 9, 11-41 of Column D), Table 3a and 3b, and under <223> identifier of the ST25 sequence listing of respective sequence SEQ ID NOs.

In particularly preferred embodiments, the nucleic acid of the first aspect comprises at least one coding sequence comprising or consisting a human codon usage adapted coding sequence which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 142, 143, 145, 150, 153, 157, 160, 164, 167, 171, 174, 11967-12033, 12473-12539, 12945-13011 or a fragment or variant of any of these sequences. Additional information regarding each of these suitable nucleic acid sequences encoding may also be derived from the sequence listing, in particular from the details provided therein under identifier <223>. Suitable coding sequences of the first aspect are provided in Table 1. Further information regarding said nucleic acid sequences is also provided in Table 1 (see rows 1 to 7, 9, 11-41 of Column E), Table 3a, and under <223> identifier of the ST25 sequence listing of respective sequence SEQ ID NOs.

In particularly preferred embodiments, the nucleic acid of the first aspect comprises at least one coding sequence comprising or consisting a G/C modified coding sequence which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 146, 147, 151, 154, 158, 161, 165, 168, 172, 175, 12034-12050, 12052, 12054-12203, 12540-12675, 13012-13147, 13519, 13520, 14133-14141, 14151-14159, 14169-14177, 23041-23076, 23149-23184, 23261-23296, 23369-23404, 23481-23516, 23589-23624, 23701-23736, 23809-23844, 23921-23956, 24029-24064, 24141-24176, 24249-24284, 24361-24396, 24469-24504, 24581-24616, 24689-24724, 24801-24836, 24909-24944, 25021-25056, 25129-25164, 25241-25276, 25349-25384, 25461-25496, 25569-25604, 25681-25716, 25789-25824, 25901-25936, 26009-26044, 26121-26156, 26229-26264, 26341-26376, 26449-26484, 26561-26596, 26669-26704, 26781-26816, 26889-26924 or a fragment or variant of any of these sequences. Additional information regarding each of these suitable nucleic acid sequences encoding may also be derived from the sequence listing, in particular from the details provided therein under identifier <223>. Suitable coding sequences of the first aspect are provided in Table 1. Further information regarding said nucleic acid sequences is also provided in Table 1 (see rows 1 to 7, 9, 11-41 of Column F), and under <223> identifier of the ST25 sequence listing of respective sequence SEQ ID NOs.

In even more preferred embodiments, the nucleic acid of the first aspect comprises at least one coding sequence comprising or consisting a G/C modified coding sequence which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence selected from the group consisting of SEQ ID NOs: 136-138, 142, 143, 146, 147, 11731, 11798-11801, 11804, 11805, 11808, 11810-11812, 11923, 11953, 12035, 12049, 22759-22785, 22965-22982, 23077-23094, 23149 or a fragment or variant of any of these sequences. Additional information regarding each of these suitable nucleic acid sequences encoding may also be derived from the sequence listing, in particular from the details provided therein under identifier <223>. Suitable coding sequences of the first aspect are provided in Table 1. Further information regarding said nucleic acid sequences is also provided in Table 1 (see rows 1 to 7, 9, 11-41 of Column F), and under <223> identifier of the ST25 sequence listing of respective sequence SEQ ID NOs.

In a particularly preferred embodiment, the nucleic acid of the first aspect comprises at least one coding sequence comprising or consisting a G/C modified coding sequence encoding a SARS-CoV-2 antigen which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence according to SEQ ID NOs: 137 or a fragment or variant thereof.

In further particularly preferred embodiments, the nucleic acid of the first aspect comprises at least one coding sequence comprising or consisting a G/C modified coding sequence encoding a SARS-CoV-2 antigen which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence according to SEQ ID NOs: 23090, 23091, 23093, 23094 or a fragment or variant thereof.

In further embodiments, the nucleic acid of the first aspect comprises at least one coding sequence comprising or consisting a coding sequence encoding a SARS-CoV-2 antigen which is identical or at least 70%, 80%, 85%, 86%, 87%, 88%, 89%, 90%, 91%, 92%, 93%, 94%, 95%, 96%, 97%, 98%, or 99% identical to a codon modified nucleic acid sequence according to SEQ ID NOs: 23113, 23167 or a fragment or variant thereof.

UTRs:

In preferred embodiments, the nucleic acid of the invention comprises a protein-coding region ("coding sequence" or "cds"), and 5'-UTR and/or 3'-UTR. Notably, UTRs may harbor regulatory sequence elements that determine nucleic acid, e.g. RNA turnover, stability, and localization. Moreover, UTRs may harbor sequence elements that enhance translation. In medical application of nucleic acid sequences (including DNA and RNA), translation of the nucleic acid into at least one peptide or protein is of paramount importance to therapeutic efficacy. Certain combinations of 3'-UTRs and/or 5'-UTRs may enhance the expression of operably linked coding sequences encoding peptides or proteins of the invention. Nucleic acid molecules harboring said UTR combinations advantageously enable rapid and transient expression of antigenic peptides or proteins after administration to a subject, preferably after intramuscular administration. Accordingly, the nucleic acid comprising certain combinations of 3'-UTRs and/or 5'-UTRs as provided herein is particularly suitable for administration as a vaccine, in particular, suitable for administration into the muscle, the dermis, or the epidermis of a subject.

Suitably, the nucleic acid of the invention comprises at least one heterologous 5'-UTR and/or at least one heterologous 3'-UTR. Said heterologous 5'-UTRs or 3'-UTRs may be derived from naturally occurring genes or may be synthetically engineered. In preferred embodiments, the nucleic acid, preferably the RNA comprises at least one coding sequence as defined herein operably linked to at least one (heterologous) 3'-UTR and/or at least one (heterologous) 5'-UTR.

In preferred embodiments, the nucleic acid, e.g. the RNA or DNA, comprises at least one heterologous 3'-UTR.

The term "3'-untranslated region" or "3'-UTR" or "3'-UTR element" will be recognized and understood by the person of ordinary skill in the art, and are e.g. intended to refer to a part of a nucleic acid molecule located 3' (i.e. downstream) of a coding sequence and which is not translated into protein. A 3'-UTR may be part of a nucleic acid, e.g. a DNA or an RNA, located between a coding sequence and an (optional) terminal poly(A) sequence. A 3'-UTR may comprise elements for controlling gene expression, also called regulatory elements. Such regulatory elements may be, e.g., ribosomal binding sites, miRNA binding sites etc.

Preferably, the nucleic acid comprises a 3'-UTR, which may be derivable from a gene that relates to an RNA with enhanced half-life (i.e. that provides a stable RNA).

In some embodiments, a 3'-UTR comprises one or more of a polyadenylation signal, a binding site for proteins that affect a nucleic acid stability of location in a cell, or one or more miRNA or binding sites for miRNAs.

MicroRNAs (or miRNA) are 19-25 nucleotide long non-coding RNAs that bind to the 3'-UTR of nucleic acid molecules and down-regulate gene expression either by reducing nucleic acid molecule stability or by inhibiting translation. E.g., microRNAs are known to regulate RNA, and thereby protein expression, e.g. in liver (miR-122), heart (miR-Id, miR-149), endothelial cells (miR-17-92, miR-126), adipose tissue (let-7, miR-30c), kidney (miR-192, miR-194, miR-204), myeloid cells (miR-142-3p, miR-142-5p, miR-16, miR-21, miR-223, miR-24, miR-27), muscle (miR-133, miR-206, miR-208), and lung epithelial cells (let-7, miR-133, miR-126). The RNA may comprise one or more microRNA target sequences, microRNA sequences, or microRNA seeds. Such sequences may e.g. correspond to any known microRNA such as those taught in US2005/0261218 and US2005/0059005.

Accordingly, miRNA, or binding sites for miRNAs as defined above may be removed from the 3'-UTR or introduced into the 3'-UTR in order to tailor the expression of the nucleic acid, e.g. the RNA to desired cell types or tissues (e.g. muscle cells).

In preferred embodiments, the nucleic acid comprises at least one heterologous 3'-UTR, wherein the at least one heterologous 3'-UTR comprises a nucleic acid sequence derived from a 3'-UTR of a gene selected from PSMB3, ALB7, alpha-globin (referred to as "muag"), CASP1, COX6B1, GNAS, NDUFA1 and RPS9, or from a homolog, a fragment or variant of any one of these genes, preferably according to nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 253-268, 22902-22905, 22892-22895 or a fragment or a variant of any of these. Particularly preferred nucleic acid sequences in that context can be derived from published PCT application WO2019/077001A1, in particular, claim 9 of WO2019/077001A1. The corresponding 3'-UTR sequences of claim 9 of WO2019/077001A1 are herewith incorporated by reference (e.g., SEQ ID NOs: 23-34 of WO2019/077001A1, or fragments or variants thereof).

In particularly preferred embodiments, the nucleic acid comprises a 3'-UTR derived from an alpha-globin gene. Said 3'-UTR derived from a alpha-globin gene ("muag") may comprise or consist of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 267, 268, 22896-22901, 22906-22911 or a fragment or a variant thereof.

In further embodiments, the nucleic acid comprises a 3'-UTR derived from a RPS9 gene. Said 3'-UTR derived from a RPS9 gene may comprise or consist of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 263 or 264, 22894, 22895, 22904, 22905 or a fragment or a variant thereof.

In preferred embodiments, the nucleic acid comprises a 3'-UTR derived from a PSMB3 gene. Said 3'-UTR derived from a PSMB3 gene may comprise or consist of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 253 or 254, 22892, 22893, 22902, 22903 or a fragment or a variant thereof.

In other embodiments, the nucleic acid comprises a 3'-UTR which comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 22876-22891 or a fragment or a variant thereof.

In other embodiments, the nucleic acid may comprise a 3'-UTR as described in WO2016/107877, the disclosure of WO2016/107877 relating to 3'-UTR sequences herewith incorporated by reference. Suitable 3'-UTRs are SEQ ID NOs: 1-24 and SEQ ID NOs: 49-318 of WO2016/107877, or fragments or variants of these sequences. In other embodiments, the nucleic acid comprises a 3'-UTR as described in WO2017/036580, the disclosure of WO2017/036580 relating to 3'-UTR sequences herewith incorporated by reference. Suitable 3'-UTRs are SEQ ID NOs: 152-204 of WO2017/036580, or fragments or variants of these sequences. In other embodiments, the nucleic acid comprises a 3'-UTR as described in WO2016/022914, the disclosure of WO2016/022914 relating to 3'-UTR sequences herewith incorporated by reference. Particularly preferred 3'-UTRs are nucleic acid sequences according to SEQ ID NOs: 20-36 of WO2016/022914, or fragments or variants of these sequences.

In preferred embodiments, the nucleic acid, e.g. the RNA or DNA, comprises at least one heterologous 5'-UTR.

The terms "5'-untranslated region" or "5'-UTR" or "5'-UTR element" will be recognized and understood by the person of ordinary skill in the art, and are e.g. intended to refer to a part of a nucleic acid molecule located 5' (i.e. "upstream") of a coding sequence and which is not translated into protein. A 5'-UTR may be part of a nucleic acid located 5' of the coding sequence. Typically, a 5'-UTR starts with the transcriptional start site and ends before the start codon of the coding sequence. A 5'-UTR may comprise elements for controlling gene expression, also called regulatory elements. Such regulatory elements may be, e.g., ribosomal binding sites, miRNA binding sites etc. The 5'-UTR may be post-transcriptionally modified, e.g. by enzymatic or post-transcriptional addition of a 5'-cap structure (e.g. for mRNA as defined below).

Preferably, the nucleic acid comprises a 5'-UTR, which may be derivable from a gene that relates to an RNA with enhanced half-life (i.e. that provides a stable RNA).

In some embodiments, a 5'-UTR comprises one or more of a binding site for proteins that affect an RNA stability or RNA location in a cell, or one or more miRNA or binding sites for miRNAs (as defined above).

Accordingly, miRNA or binding sites for miRNAs as defined above may be removed from the 5'-UTR or introduced into the 5'-UTR in order to tailor the expression of the nucleic acid to desired cell types or tissues (e.g. muscle cells).

In preferred embodiments, the nucleic acid comprises at least one heterologous 5'-UTR, wherein the at least one heterologous 5'-UTR comprises a nucleic acid sequence derived from a 5'-UTR of gene selected from HSD17B4, RPL32, ASAH1, ATP5A1, MP68, NDUFA4, NOSIP, RPL31, SLC7A3, TUBB4B, and UBQLN2, or from a homolog, a fragment or variant of any one of these genes according to nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 231-252, 22870-22875 or a fragment or a variant of any of these. Particularly preferred nucleic acid sequences in that context can be selected from published PCT application WO2019/077001A1, in particular, claim 9 of WO2019/077001A1. The corresponding 5'-UTR sequences of claim 9 of WO2019/077001A1 are herewith incorporated by reference (e.g., SEQ ID NOs: 1-20 of WO2019/077001A1, or fragments or variants thereof).

In preferred embodiments, the nucleic acid comprises a 5'-UTR derived from a RPL31 gene, wherein said 5'-UTR derived from a RPL31 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 243, 244, 22872, 22873 or a fragment or a variant thereof.

In other embodiments, the nucleic acid comprises a 5'-UTR derived from a SLC7A3 gene, wherein said 5'-UTR derived from a SLC7A3 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 245, 246, 22874, 22875 or a fragment or a variant thereof.

In particularly preferred embodiments, the nucleic acid comprises a 5'-UTR derived from a HSD17B4 gene, wherein said 5'-UTR derived from a HSD17B4 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 231, 232, 22870, 22871 or a fragment or a variant thereof.

In other embodiments, the nucleic acid comprises a 5'-UTR which comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 22848-22869 or a fragment or a variant thereof.

In other embodiments, the nucleic acid comprises a 5'-UTR as described in WO2013/143700, the disclosure of WO2013/143700 relating to 5'-UTR sequences herewith incorporated by reference. Particularly preferred 5'-UTRs are nucleic acid sequences derived from SEQ ID NOs: 1-1363, SEQ ID NO: 1395, SEQ ID NO: 1421 and SEQ ID NO: 1422 of WO2013/143700, or fragments or variants of these sequences. In other embodiments, the nucleic acid comprises a 5'-UTR as described in WO2016/107877, the disclosure of WO2016/107877 relating to 5'-UTR sequences herewith incorporated by reference. Particularly preferred 5'-UTRs are nucleic acid sequences according to SEQ ID NOs: 25-30 and SEQ ID NOs: 319-382 of WO2016/107877, or fragments or variants of these sequences. In other embodiments, the nucleic acid comprises a 5'-UTR as described in WO2017/036580, the disclosure of WO2017/036580 relating to 5'-UTR sequences herewith incorporated by reference. Particularly preferred 5'-UTRs are nucleic acid sequences according to SEQ ID NOs: 1-151 of WO2017/036580, or fragments or variants of these sequences. In other embodiments, the nucleic acid comprises a 5'-UTR as described in WO2016/022914, the disclosure of WO2016/022914 relating to 5'-UTR sequences herewith incorporated by reference. Particularly preferred 5'-UTRs are nucleic acid sequences according to SEQ ID NOs: 3-19 of WO2016/022914, or fragments or variants of these sequences.

Suitably, in preferred embodiments, the nucleic acid comprises at least one coding sequence as specified herein encoding at least one antigenic protein as defined herein, preferably derived from SARS-CoV-2 (nCoV-2019) coronavirus, operably linked to a 3'-UTR and/or a 5'-UTR selected from the following 5'UTR/3'UTR combinations ("also referred to UTR designs"):

a-1 (HSD17B4/PSMB3), a-2 (NDUFA4/PSMB3), a-3 (SLC7A3/PSMB3), a-4 (NOSIP/PSMB3), a-5 (MP68/PSMB3), b-1 (UBQLN2/RPS9), b-2 (ASAH1/RPS9), b-3 (HSD17B4/RPS9), b-4 (HSD17B4/CASP1), b-5 (NOSIP/COX6B1), c-1 (NDUFA4/RPS9), c-2 (NOSIP/NDUFA1), c-3 (NDUFA4/COX6B1), c-4 (NDUFA4/NDUFA1), c-5 (ATP5A1/PSMB3), d-1 (RpI31/PSMB3), d-2 (ATP5A1/CASP1), d-3 (SLC7A3/GNAS), d-4 (HSD17B4/NDUFA1), d-5 (Slc7a3/Ndufa1), e-1 (TUBB4B/RPS9), e-2 (RPL31/RPS9), e-3 (MP68/RPS9), e-4 (NOSIP/RPS9), e-5

(ATP5A1/RPS9), e-6 (ATP5A1/COX6B1), f-1 (ATP5A1/GNAS), f-2 (ATP5A1/NDUFA1), f-3 (HSD17B4/COX6B1), f-4 (HSD17B4/GNAS), f-5 (MP68/COX6B1), g-1 (MP68/NDUFA1), g-2 (NDUFA4/CASP1), g-3 (NDUFA4/GNAS), g-4 (NOSIP/CASP1), g-5 (RPL31/CASP1), h-1 (RPL31/COX6B1), h-2 (RPL31/GNAS), h-3 (RPL31/NDUFA1), h-4 (Slc7a3/CASP1), h-5 (SLC7A3/COX6B1), i-1 (SLC7A3/RPS9), i-2 (RPL32/ALB7), i-2 (RPL32/ALB7), or i-3 (alpha-globin gene).

In particularly preferred embodiments, the nucleic acid comprises at least one coding sequence as specified herein encoding at least one antigenic protein as defined herein, preferably derived from SARS-CoV-2 (nCoV-2019) coronavirus, wherein said coding sequence is operably linked to a HSD17B4 5'-UTR and a PSMB3 3'-UTR (HSD17B4/PSMB3 (UTR design a-1)).

It has been shown by the inventors that this embodiment is particularly beneficial for induction an immune response against SARS-CoV-2. In this context, it could be shown that already one vaccination was sufficient to result in virus-neutralizing antibody titers.

In further preferred embodiments, the nucleic acid comprises at least one coding sequence as specified herein encoding at least one antigenic protein as defined herein, preferably derived from SARS-CoV-2 (nCoV-2019) coronavirus, wherein said coding sequence is operably linked to a SLC7A3 5'-UTR and a PSMB3 3'-UTR (SLC7A3/PSMB3 (UTR design a-3)).

In further preferred embodiments, the nucleic acid comprises at least one coding sequence as specified herein encoding at least one antigenic protein as defined herein, preferably derived from SARS-CoV-2 (nCoV-2019) coronavirus, wherein said coding sequence is operably linked to a RPL31 5'-UTR and a RPS9 3'-UTR (RPL31/RPS9 (UTR design e-2)).

In particularly preferred embodiments of the nucleic acid comprises at least one coding sequence as specified herein encoding at least one antigenic protein as defined herein, preferably derived from SARS-CoV-2 (nCoV-2019) coronavirus, wherein said coding sequence is operably linked to an alpha-globin ("muag") 3'-UTR (-/muag)(UTR design i-3)).

In some embodiments, the nucleic acid, e.g. the DNA or RNA may be monocistronic, bicistronic, or multicistronic.

The term "monocistronic" will be recognized and understood by the person of ordinary skill in the art, and is e.g. intended to refer to a nucleic acid that comprises only one coding sequence. The terms "bicistronic", or "multicistronic" as used herein will be recognized and understood by the person of ordinary skill in the art, and are e.g. intended to refer to a nucleic acid that may comprise two (bicistronic) or more (multicistronic) coding sequences.

In preferred embodiments, the nucleic acid of the first aspect is monocistronic.

In other embodiments, the nucleic acid is monocistronic and the coding sequence of said nucleic acid encodes at least two different antigenic peptides or proteins derived from a SARS-CoV-2 coronavirus. Accordingly, said coding sequence may encode at least two, three, four, five, six, seven, eight and more antigenic peptides or proteins derived from a SARS-CoV-2 coronavirus, linked with or without an amino acid linker sequence, wherein said linker sequence can comprise rigid linkers, flexible linkers, cleavable linkers, or a combination thereof. Such constructs are herein referred to as "multi-antigen-constructs".

In further embodiments, the nucleic acid may be bicistronic or multicistronic and comprises at least two coding sequences, wherein the at least two coding sequences encode two or more different antigenic peptides or proteins derived from a SARS-CoV-2 coronavirus. Accordingly, the coding sequences in a bicistronic or multicistronic nucleic acid suitably encodes distinct antigenic proteins or peptides as defined herein or immunogenic fragments or immunogenic variants thereof. Preferably, the coding sequences in said bicistronic or multicistronic constructs may be separated by at least one IRES (internal ribosomal entry site) sequence. Thus, the term "encoding two or more antigenic peptides or proteins" may mean, without being limited thereto, that the bicistronic or multicistronic nucleic acid encodes e.g. at least two, three, four, five, six or more (preferably different) antigenic peptides or proteins of different SARS-CoV-2 coronavirus isolates. Alternatively, the bicistronic or multicistronic nucleic acid may encode e.g. at least two, three, four, five, six or more (preferably different) antigenic peptides or proteins derived from the same SARS-CoV-2 coronavirus. In that context, suitable IRES sequences may be selected from the list of nucleic acid sequences according to SEQ ID NOs: 1566-1662 of the patent application WO2017/081082, or fragments or variants of these sequences. In this context, the disclosure of WO2017/081082 relating to IRES sequences is herewith incorporated by reference.

It has to be understood that, in the context of the invention, certain combinations of coding sequences may be generated by any combination of monocistronic, bicistronic and multicistronic DNA and/or RNA constructs and/or multi-antigen-constructs to obtain a nucleic acid set encoding multiple antigenic peptides or proteins as defined herein.

In preferred embodiments, the A/U (A/T) content in the environment of the ribosome binding site of the nucleic acid may be increased compared to the A/U (NT) content in the environment of the ribosome binding site of its respective wild type or reference nucleic acid. This modification (an increased A/U (A/T) content around the ribosome binding site) increases the efficiency of ribosome binding to the nucleic acid, e.g. to an RNA. An effective binding of the ribosomes to the ribosome binding site in turn has the effect of an efficient translation the nucleic acid.

Accordingly, in a particularly preferred embodiment, the nucleic acid comprises a ribosome binding site, also referred to as "Kozak sequence" identical to or at least 80%, 85%, 90%, 95% identical to any one of the sequences SEQ ID NO: 180, SEQ ID NO: 181, acc, gccgccacc, gccacc, or fragments or variants thereof.

In preferred embodiments, the nucleic acid of the invention comprises at least one poly(N) sequence, e.g. at least one poly(A) sequence, at least one poly(U) sequence, at least one poly(C) sequence, or combinations thereof.

In preferred embodiments, the nucleic acid of the invention, preferably the RNA comprises at least one poly(A) sequence.

The terms "poly(A) sequence", "poly(A) tail" or "3'-poly (A) tail" as used herein will be recognized and understood by the person of ordinary skill in the art, and are e.g. intended to be a sequence of adenosine nucleotides, typically located at the 3'-end of a linear RNA (or in a circular RNA), of up to about 1000 adenosine nucleotides. Preferably, said poly(A) sequence is essentially homopolymeric, e.g. a poly(A) sequence of e.g. 100 adenosine nucleotides has essentially the length of 100 nucleotides. In other embodiments, the poly(A) sequence may be interrupted by at least one nucleotide different from an adenosine nucleotide, e.g. a poly(A) sequence of e.g. 100 adenosine nucleotides may have a length of more than 100 nucleotides (comprising 100 adenosine nucleotides and in addition said at least one nucleotide—or a stretch of nucleotides—different from an adenosine nucleotide). It has to be understood that "poly(A) sequence" as defined herein typically relates to RNA—however in the context of the invention, the term likewise relates to corresponding sequences in a DNA molecule (e.g. a "poly(T) sequence").

The poly(A) sequence may comprise about 10 to about 500 adenosine nucleotides, about 10 to about 200 adenosine nucleotides, about 40 to about 200 adenosine nucleotides, or about 40 to about 150 adenosine nucleotides. Suitably, the length of the poly(A) sequence may be at least about or even more than about 10, 50, 64, 75, 100, 200, 300, 400, or 500 adenosine nucleotides.

In preferred embodiments, the nucleic acid comprises at least one poly(A) sequence comprising about 30 to about 200 adenosine nucleotides. In particularly preferred embodiments, the poly(A) sequence comprises about 64 adenosine nucleotides (A64). In other particularly preferred embodiments, the poly(A) sequence comprises about 100 adenosine nucleotides (A100). In other embodiments, the poly(A) sequence comprises about 150 adenosine nucleotides.

In further embodiments, the nucleic acid comprises at least one poly(A) sequence comprising about 100 adenosine nucleotides, wherein the poly(A) sequence is interrupted by non-adenosine nucleotides, preferably by 10 non-adenosine nucleotides (A30-N10-A70).

The poly(A) sequence as defined herein may be located directly at the 3' terminus of the nucleic acid, preferably directly at the 3' terminus of an RNA.

In preferred embodiments, the 3'-terminal nucleotide (that is the last 3'-terminal nucleotide in the polynucleotide chain) is the 3'-terminal A nucleotide of the at least one poly(A) sequence. The term "directly located at the 3' terminus" has to be understood as being located exactly at the 3' terminus—in other words, the 3' terminus of the nucleic acid consists of a poly(A) sequence terminating with an A nucleotide.

It has been shown by the inventors that this embodiment is particularly beneficial for induction an immune response against SARS-CoV-2. In this context, it could be shown that already one vaccination was sufficient to result in virus-neutralizing antibody titers.

In a particularly preferred embodiment the nucleic acid sequence, preferably the RNA comprises a poly(A) sequence of at least 70 adenosine nucleotides, wherein the 3'-terminal nucleotide is an adenosine nucleotide.

In this context it has been shown that ending on an adenosine nucleotide decreases the induction of IFNalpha by the RNA vaccine. This is particularly important as the induction of IFNalpha is thought to be the main factor for induction of fever in vaccinated subjects, which of course has to be avoided.

In embodiments where the nucleic acid is an RNA, the poly(A) sequence of the nucleic acid is preferably obtained from a DNA template during RNA in vitro transcription. In other embodiments, the poly(A) sequence is obtained in vitro by common methods of chemical synthesis without being necessarily transcribed from a DNA template. In other embodiments, poly(A) sequences are generated by enzymatic polyadenylation of the RNA (after RNA in vitro transcription) using commercially available polyadenylation kits and corresponding protocols known in the art, or alternatively, by using immobilized poly(A)polymerases e.g. using a methods and means as described in WO2016/174271.

The nucleic acid may comprise a poly(A) sequence obtained by enzymatic polyadenylation, wherein the majority of nucleic acid molecules comprise about 100 (+/−20) to about 500 (+/−50), preferably about 250 (+/−20) adenosine nucleotides.

In other embodiments, the nucleic acid may comprise a poly(A) sequence derived from a template DNA and may additionally comprise at least one additional poly(A) sequence generated by enzymatic polyadenylation, e.g. as described in WO2016/091391.

In further embodiments, the nucleic acid comprises at least one polyadenylation signal.

In other embodiments, the nucleic acid may comprise at least one poly(C) sequence.

The term "poly(C) sequence" as used herein is intended to be a sequence of cytosine nucleotides of up to about 200 cytosine nucleotides. In preferred embodiments, the poly(C) sequence comprises about 10 to about 200 cytosine nucleotides, about 10 to about 100 cytosine nucleotides, about 20 to about 70 cytosine nucleotides, about 20 to about 60 cytosine nucleotides, or about 10 to about 40 cytosine nucleotides. In a particularly preferred embodiment, the poly(C) sequence comprises about 30 cytosine nucleotides.

In preferred embodiments, the nucleic acid of the invention comprises at least one histone stem-loop (hSL).

The term "histone stem-loop" (abbreviated as "hSL" in e.g. the sequence listing) is intended to refer to nucleic acid sequences that form a stem-loop secondary structure predominantly found in histone mRNAs.

Histone stem-loop sequences/structures may suitably be selected from histone stem-loop sequences as disclosed in WO2012/019780, the disclosure relating to histone stem-loop sequences/histone stem-loop structures incorporated herewith by reference. A histone stem-loop sequence that may be used within the present invention may preferably be derived from formulae (I) or (II) of WO2012/019780. According to a further preferred embodiment, the nucleic acid may comprise at least one histone stem-loop sequence derived from at least one of the specific formulae (Ia) or (IIa) of the patent application WO2012/019780.

In preferred embodiments, the nucleic acid of the invention comprises at least one histone stem-loop, wherein said histone stem-loop (hSL) comprises or consists a nucleic acid sequence identical or at least 70%, 80%, 90%, 91%, 92%, 93%, 94%, 95%, 96%, 97%, 98%, or 99% identical to SEQ ID NOs: 178 or 179, or fragments or variants thereof.

In other embodiments, the RNA of the first aspect does not comprise a histone stem-loop as defined herein.

In some embodiments, in particular in embodiments that relate to RNA, the nucleic acid comprises a 3'-terminal sequence element. Said 3'-terminal sequence element comprises a poly(A) sequence and optionally a histone-stem-loop sequence. Accordingly, the nucleic acid of the invention comprises at least one 3'-terminal sequence element comprising or consisting of a nucleic acid sequence being identical or at least 70%, 80%, 90%, 91%, 92%, 93%, 94%, 95%, 96%, 97%, 98%, or 99% identical to SEQ ID NOs: 182-230, 22912, 22913 or a fragment or variant thereof.

In preferred embodiments, in particular in embodiments that relate to RNA, the nucleic acid comprises a 3'-terminal sequence element. Said 3'-terminal sequence element comprises a poly(A) sequence and optionally a histone-stem-loop sequence. Accordingly, the nucleic acid of the invention comprises at least one 3'-terminal sequence element comprising or consisting of a nucleic acid sequence being identical or at least 70%, 80%, 90%, 91%, 92%, 93%, 94%, 95%, 96%, 97%, 98%, or 99% identical to SEQ ID NOs: 182, 187, 189, 192, 199, 207, or a fragment or variant thereof.

In various embodiments, in particular in embodiments that relate to RNA, the nucleic acid may comprise a 5'-terminal sequence element having the sequence gggaga, aggaga, gggaaa, agaaua, agauua, gauggg, gggcg, or a fragment or variant thereof. Such a 5'-terminal sequence element comprises e.g. a binding site for T7 RNA polymerase. Further, the first nucleotide of said 5'-terminal start sequence may preferably comprise a 2' methylation, e.g. 2' methylated guanosine or a 2' methylated adenosine.

Preferably, the nucleic acid of the first aspect, e.g. the RNA or DNA, typically comprises about 50 to about 20000 nucleotides, or about 500 to about 10000 nucleotides, or about 1000 to about 10000 nucleotides, or preferably about 1000 to about 5000 nucleotides, or even more preferably about 2000 to about 5000 nucleotides.

In some embodiments, the nucleic acid is a DNA or an RNA.

In various embodiments, the DNA is a plasmid DNA or a linear coding DNA construct, wherein the DNA comprises or consists of the nucleic acid elements as defined herein (e.g. including coding sequences, UTRs, poly(A/T), polyadenylation signal, a promoter).

In preferred embodiments, the nucleic acid is a DNA expression vector. Such a DNA expression vector may be selected from the group consisting of a bacterial plasmid, an adenovirus, a poxvirus, a parapoxvirus (orf virus), a vaccinia virus, a fowlpox virus, a herpes virus, an adeno-associated virus (AAV), an alphavirus, a lentivirus, a lambda phage, a lymphocytic choriomeningitis virus and a *Listeria* sp, *Salmonella* sp.

Suitably, the DNA may also comprise a promoter that is operably linked to the SARS-CoV-2 antigen coding sequence. The promoter operably linked to the antigen coding sequence can be e.g. a promoter from simian virus 40 (SV40), a mouse mammary tumor virus (MMTV) promoter, a human immunodeficiency virus (HIV) promoter such as the bovine immunodeficiency virus (BIV) long terminal repeat (LTR) promoter, a Moloney virus promoter, an avian leukosis virus (ALV) promoter, a cytomegalovirus (CMV) promoter such as the CMV immediate early promoter, Epstein Barr virus (EBV) promoter, or a Rous sarcoma virus (RSV) promoter. The promoter can also be a promoter from a human gene such as human actin, human myosin, human hemoglobin, human muscle creatine, or human metalothionein. The promoter can also be a tissue specific promoter, such as a muscle or skin specific promoter, natural or synthetic. Examples of such promoters are described in US patent application publication no. US20040175727. In preferred embodiments, the vector can be pVAX, pcDNA3.0, or provax, or any other expression vector capable of expressing DNA encoding the coronavirus antigen and enabling a cell to translate the sequence to an antigen that is recognized by the immune system.

Further suitable plasmid DNA may be generated to allow efficient production of the encoded SARS-CoV-2 antigen in cell lines, e.g. in insect cell lines, for example using vectors as described in WO2009150222A2 and as defined in PCT claims 1 to 33, the disclosure relating to claims 1 to 33 of WO2009150222A2 herewith incorporated by reference.

In other embodiments, the nucleic acid of the first aspect is an adenovirus based vector. Such an adenovirus based vector may comprise at least one coding sequence encoding at least one SARS-CoV-2 antigenic peptide or protein as defined herein.

In the context of the invention, any suitable adenovirus based vector may be used such as those described in WO2005/071093 or WO2006/048215. Suitably, the adenovirus based vector used is a simian adenovirus, thereby avoiding dampening of the immune response after vaccination by pre-existing antibodies to common human entities such as AdHu5. Suitable simian adenovirus vectors include AdCh63 (patent number WO/2005/071093) or AdCh68 (Cohen et al J. Gen Virol 2002 83:151) but others may also be used. Suitably the adenovirus vector will have the E1 region deleted, rendering it replication-deficient in human cells. Other regions of the adenovirus such as E3 and E4 may also be deleted.

In additional embodiments, the nucleic acid of the first aspect is an orf virus based vector. Such an adenovirus based vector may comprise at least one coding sequence encoding at least one SARS-CoV-2 antigenic peptide or protein as defined herein.

In particularly preferred embodiments of the invention, the nucleic acid of the invention is an RNA.

Preferably, the RNA typically comprises about 50 to about 20000 nucleotides, or about 500 to about 10000 nucleotides, or about 1000 to about 10000 nucleotides, or preferably about 1000 to about 5000 nucleotides, or even more preferably about 2000 to about 5000 nucleotides.

According to preferred embodiments, the nucleic acid is an RNA, preferably a coding RNA.

In preferred embodiments, the coding RNA may be selected from an mRNA, a (coding) self-replicating RNA, a (coding) circular RNA, a (coding) viral RNA, or a (coding) replicon RNA.

In other embodiments, the coding RNA is a circular RNA. As used herein, "circular RNA" or "circRNAs" have to be understood as a circular polynucleotide constructs that encode at least one antigenic peptide or protein as defined herein. Preferably, such a circRNA is a single stranded RNA molecule. In preferred embodiments, said circRNA comprises at least one coding sequence encoding at least one antigenic protein from a SARS-CoV-2 coronavirus, or an immunogenic fragment or an immunogenic variant thereof.

In further embodiments, the coding RNA is a replicon RNA. The term "replicon RNA" will be recognized and understood by the person of ordinary skill in the art, and is e.g. intended to be an optimized self-replicating RNA. Such constructs may include replicase elements derived from e.g. alphaviruses (e.g. SFV, SIN, VEE, or RRV) and the substitution of the structural virus proteins with the nucleic acid of interest (that is, the coding sequence encoding an antigenic peptide or protein of a SARS-CoV-2 coronavirus). Alternatively, the replicase may be provided on an independent coding RNA construct or a coding DNA construct. Downstream of the replicase may be a sub-genomic promoter that controls replication of the replicon RNA.

In particularly preferred embodiments, the at least one nucleic acid is not a replicon RNA or a self-replicating RNA.

In particularly preferred embodiments, the nucleic acid of the invention is an mRNA.

Preferably, the mRNA does not comprise a replicase element (e.g. a nucleic acid encoding a replicase).

The terms "RNA" and "mRNA" will be recognized and understood by the person of ordinary skill in the art, and are e.g. intended to be a ribonucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. The mRNA (messenger RNA) provides the nucleotide coding sequence that may be translated into an amino-acid sequence of a particular peptide or protein.

In the context of the invention, the coding RNA, preferably the mRNA, may provide at least one coding sequence encoding an antigenic protein from a SARS-CoV-2 that is translated into a (functional) antigen after administration (e.g. after administration to a subject, e.g. a human subject).

Accordingly, the coding RNA, preferably the mRNA, is suitable for a vaccine, preferably a SARS-CoV-2 vaccine.

Suitably, the coding RNA may be modified by the addition of a 5'-cap structure, which preferably stabilizes the coding RNA and/or enhances expression of the encoded antigen and/or reduces the stimulation of the innate immune system (after administration to a subject). A 5'-cap structure is of particular importance in embodiments where the nucleic acid is an RNA, in particular a linear coding RNA, e.g. a linear mRNA or a linear coding replicon RNA.

Accordingly, in preferred embodiments, the RNA, in particular the coding RNA comprises a 5'-cap structure, preferably cap0, cap1, cap2, a modified cap0, or a modified cap1 structure.

The term "5'-cap structure" as used herein will be recognized and understood by the person of ordinary skill in the art, and is e.g. intended to refer to a 5' modified nucleotide, particularly a guanine nucleotide, positioned at the 5'-end of an RNA, e.g. an mRNA. Preferably, the 5'-cap structure is connected via a 5'-5'-triphosphate linkage to the RNA.

5'-cap structures which may be suitable in the context of the present invention are cap0 (methylation of the first nucleobase, e.g. m7GpppN), cap1 (additional methylation of the ribose of the adjacent nucleotide of m7GpppN), cap2 (additional methylation of the ribose of the 2nd nucleotide downstream of the m7GpppN), cap3 (additional methylation of the ribose of the 3rd nucleotide downstream of the m7GpppN), cap4 (additional methylation of the ribose of the 4th nucleotide downstream of the m7GpppN), ARCA (anti-reverse cap analogue), modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

A 5'-cap (cap0 or cap1) structure may be formed in chemical RNA synthesis or in RNA in vitro transcription (co-transcriptional capping) using cap analogues.

The term "cap analogue" as used herein will be recognized and understood by the person of ordinary skill in the art, and is e.g. intended to refer to a non-polymerizable di-nucleotide or tri-nucleotide that has cap functionality in that it facilitates translation or localization, and/or prevents degradation of a nucleic acid molecule, particularly of an RNA molecule, when incorporated at the 5'-end of the nucleic acid molecule. Non-polymerizable means that the cap analogue will be incorporated only at the 5'-terminus because it does not have a 5' triphosphate and therefore cannot be extended in the 3'-direction by a template-dependent polymerase, particularly, by template-dependent RNA polymerase. Examples of cap analogues include, but are not limited to, a chemical structure selected from the group consisting of m7GpppG, m7GpppA, m7GpppC; unmethylated cap analogues (e.g. GpppG); dimethylated cap analogue (e.g. m2,7GpppG), trimethylated cap analogue (e.g. m2,2,7GpppG), dimethylated symmetrical cap analogues (e.g. m7Gpppm7G), or anti reverse cap analogues (e.g. ARCA; m7,2'OmeGpppG, m7,2' dGpppG, m7,3'OmeGpppG, m7,3' dGpppG and their tetraphosphate derivatives). Further cap analogues have been described previously (WO2008/016473, WO2008/157688, WO2009/149253, WO2011/015347, and WO2013/059475). Further suitable cap analogues in that context are described in WO2017/066793, WO2017/066781, WO2017/066791, WO2017/066789, WO2017/053297, WO2017/066782, WO2018/075827 and WO2017/066797 wherein the disclosures referring to cap analogues are incorporated herewith by reference.

In some embodiments, a modified cap1 structure is generated using tri-nucleotide cap analogue as disclosed in WO2017/053297, WO2017/066793, WO2017/066781, WO2017/066791, WO2017/066789, WO2017/066782, WO2018/075827 and WO2017/066797. In particular, any cap structures derivable from the structure disclosed in claim 1-5 of WO2017/053297 may be suitably used to co-transcriptionally generate a modified cap1 structure. Further, any cap structures derivable from the structure defined in claim 1 or claim 21 of WO2018/075827 may be suitably used to co-transcriptionally generate a modified cap1 structure.

In preferred embodiments, the (coding) RNA, in particular the mRNA comprises a cap1 structure.

In preferred embodiments, the 5'-cap structure may suitably be added co-transcriptionally using tri-nucleotide cap analogue as defined herein in an RNA in vitro transcription reaction as defined herein.

In preferred embodiments, the cap1 structure of the coding RNA of the invention is formed using co-transcriptional capping using tri-nucleotide cap analogues m7G(5')ppp(5')(2'OMeA)pG or m7G(5')ppp(5')(2'OMeG)pG. A preferred cap1 analogues in that context is m7G(5')ppp(5')(2'OMeA)pG.

In other preferred embodiments, the cap1 structure of the RNA of the invention is formed using co-transcriptional capping using tri-nucleotide cap analogue 3'OMe-m7G(5')ppp(5')(2'OMeA)pG.

In other embodiments, a cap0 structure of the RNA of the invention is formed using co-transcriptional capping using cap analogue 3'OMe-m7G(5')ppp(5')G.

In other embodiments, the 5'-cap structure is formed via enzymatic capping using capping enzymes (e.g. vaccinia virus capping enzymes and/or cap-dependent 2'-O methyltransferases) to generate cap0 or cap1 or cap2 structures. The 5'-cap structure (cap0 or cap1) may be added using immobilized capping enzymes and/or cap-dependent 2'-O methyltransferases using methods and means disclosed in WO2016/193226.

In preferred embodiments, about 70%, 75%, 80%, 85%, 90%, 95% of the RNA (species) comprises a cap1 structure as determined using a capping assay. In preferred embodiments, less than about 20%, 15%, 10%, 5%, 4%, 3%, 2%, 1% of the RNA (species) does not comprises a cap1 structure as determined using a capping assay. In other preferred embodiments, about 70%, 75%, 80%, 85%, 90%, 95% of the RNA (species) comprises a cap0 structure as determined using a capping assay. In preferred embodiments, less than about 20%, 15%, 10%, 5%, 4%, 3%, 2%, 1% of the RNA (species) does not comprises a cap0 structure as determined using a capping assay.

The term "RNA species" is not restricted to mean "one single molecule" but is understood to comprise an ensemble of essentially identical RNA molecules. Accordingly, it may relate to a plurality of essentially identical (coding) RNA molecules.

For determining the presence/absence of a cap0 or a cap1 structure, a capping assays as described in published PCT application WO2015/101416, in particular, as described in claims 27 to 46 of published PCT application WO2015/101416 can be used. Other capping assays that may be used to determine the presence/absence of a cap0 or a cap1 structure of an RNA are described in PCT/EP2018/08667, or published PCT applications WO2014/152673 and WO2014/152659.

In preferred embodiments, the RNA comprises an m7G (5')ppp(5')(2'OMeA) cap structure. In such embodiments, the coding RNA comprises a 5'-terminal m7G cap, and an additional methylation of the ribose of the adjacent nucleotide of m7GpppN, in that case, a 2' methylated Adenosine. Preferably, about 70%, 75%, 80%, 85%, 90%, 95% of the RNA (species) comprises such a cap1 structure as determined using a capping assay.

In other preferred embodiments, the RNA comprises an m7G(5')ppp(5')(2'OMeG) cap structure. In such embodiments, the coding RNA comprises a 5'-terminal m7G cap, and an additional methylation of the ribose of the adjacent nucleotide, in that case, a 2' methylated guanosine. Preferably, about 70%, 75%, 80%, 85%, 90%, 95% of the coding RNA (species) comprises such a cap1 structure as determined using a capping assay.

Accordingly, the first nucleotide of said RNA or mRNA sequence, that is, the nucleotide downstream of the m7G (5')ppp structure, may be a 2' methylated guanosine or a 2' methylated adenosine.

According to some embodiments, the RNA is a modified RNA, wherein the modification refers to chemical modifications comprising backbone modifications as well as sugar modifications or base modifications.

A modified RNA may comprise nucleotide analogues/modifications, e.g. backbone modifications, sugar modifications or base modifications. A backbone modification in the context of the invention is a modification, in which phosphates of the backbone of the nucleotides of the RNA are chemically modified. A sugar modification in the context of the invention is a chemical modification of the sugar of the nucleotides of the RNA. Furthermore, a base modification in the context of the invention is a chemical modification of the base moiety of the nucleotides of the RNA. In this context, nucleotide analogues or modifications are preferably selected from nucleotide analogues which are applicable for transcription and/or translation.

In particularly preferred embodiments, the nucleotide analogues/modifications which may be incorporated into a modified RNA as described herein are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate, pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine, 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyl-adenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, 5'-O-(1-thiophosphate)-adenosine, 5'-O-(1-thiophosphate)-cytidine, 5'-O-(1-thiophosphate)-guanosine, 5'-O-(1-thiophosphate)-uridine, 5'-O-(1-thiophosphate)-pseudouridine, 6-aza-cytidine, 2-thio-cytidine, alpha-thio-cytidine, Pseudo-iso-cytidine, 5-aminoallyl-uridine, 5-iodo-uridine, N1-methyl-pseudouridine, 5,6-dihydrouridine, alpha-thio-uridine, 4-thio-uridine, 6-aza-uridine, 5-hydroxy-uridine, deoxy-thymidine, 5-methyl-uridine, Pyrrolo-cytidine, inosine, alpha-thio-guanosine, 6-methyl-guanosine, 5-methyl-cytidine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, alpha-thio-adenosine, 8-azido-adenosine, 7-deaza-adenosine.

In some embodiments, the at least one modified nucleotide is selected from pseudouridine, N1-methylpseudouridine, N1-ethylpseudouridine, 2-thiouridine, 4'-thiouridine, 5-methylcytosine, 5-methyluridine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine.

In some embodiments, 100% of the uracil in the coding sequence as defined herein have a chemical modification, preferably a chemical modification is in the 5-position of the uracil.

Particularly preferred in the context of the invention are pseudouridine (ψ), N1-methylpseudouridine (m1ψ), 5-methylcytosine, and 5-methoxyuridine.

In some embodiments, however, a polynucleotide molecule of the embodiments does not include any N1-methylpseudouridine (m1ψ) substituted positions. In further aspects, a polynucleotide molecule of the embodiments does not include any pseudouridine N1-methylpseudouridine (m1ψ), 5-methylcytosine, and 5-methoxyuridine substituted position. In still further aspects, a polynucleotide molecule of the embodiments comprises a coding sequence that consists only of G, C, A and U nucleotides.

Incorporating modified nucleotides such as pseudouridine N1-methylpseudouridine (m1ψ), 5-methylcytosine, and/or 5-methoxyuridine into the coding sequence of the RNA may be advantageous as unwanted innate immune responses (upon administration of the coding RNA or the vaccine) may be adjusted or reduced (if required).

In some embodiments, the RNA comprises at least one coding sequence encoding a SARS-CoV-2 antigenic protein as defined herein, wherein said coding sequence comprises at least one modified nucleotide selected from pseudouridine (ψ) and N1-methylpseudouridine (m1ψ), preferably wherein all uracil nucleotides are replaced by pseudouridine (ψ) nucleotides and/or N1-methylpseudouridine (m1ψ) nucleotides.

In preferred embodiments, the RNA does not comprise N1-methylpseudouridine (m1ψ) substituted positions. In further embodiments, the RNA does not comprise pseudouridine N1-methylpseudouridine (m1ψ), 5-methylcytosine, and 5-methoxyuridine substituted position.

In preferred embodiments, the RNA comprises a coding sequence that consists only of G, C, A and U nucleotides and therefore does not comprise modified nucleotides (except of the Cap analogue).

Nucleic Acid, Preferably mRNA Constructs Suitable for a Coronavirus Vaccine:

In various embodiments the nucleic acid, preferably the mRNA comprises, preferably in 5'- to 3'-direction, the following elements:
A) 5'-cap structure, preferably as specified herein;
B) 5'-terminal start element, preferably as specified herein;
C) optionally, a 5'-UTR, preferably as specified herein;
D) a ribosome binding site, preferably as specified herein;
E) at least one coding sequence, preferably as specified herein;
F) 3'-UTR, preferably as specified herein;
G) optionally, poly(A) sequence, preferably as specified herein;
H) optionally, poly(C) sequence, preferably as specified herein;
I) optionally, histone stem-loop preferably as specified herein;

J) optionally, 3'-terminal sequence element, preferably as specified herein.

In preferred embodiments the nucleic acid, preferably the mRNA, comprises the following elements preferably in 5'- to 3'-direction:

A) 5'-cap structure selected from m7G(5'), m7G(5')ppp (5')(2'OMeA), or m7G(5')ppp(5')(2'OMeG);
B) 5'-terminal start element selected from gggaga, aggaga, or fragments or variants thereof;
C) optionally, a 5'-UTR derived from a HSD17B4 gene;
D) a ribosome binding site selected from SEQ ID NOs: 180, SEQ ID NO: 181, acc, gccgccacc, gccacc, or fragments or variants thereof;
E) at least one coding sequence selected from SEQ ID NOs: 116-132, 134-138, 140-143, 145-175, 11664-11813, 11815, 11817-12050, 12052, 12054-12203, 13514, 13515, 13519, 13520, 14124-14141, 22759, 22764-22785, 22969-23184 or fragments or variants thereof;
F) 3'-UTR derived from a 3'-UTR of a PSMB3 gene or an alpha-globin gene ("muag");
G) optionally, poly(A) sequence comprising about 30 to about 500 adenosines;
H) optionally, poly(C) sequence comprising about 10 to about 100 cytosines;
I) optionally, histone stem-loop selected from SEQ ID NOs: 178 or 179;
J) optionally, 3'-terminal sequence element selected from SEQ ID NOs: 182-230.

In particularly preferred embodiments the nucleic acid, preferably the mRNA, comprises the following elements in 5'- to 3'-direction:

A) cap1 structure as defined herein;
B) coding sequence selected from SEQ ID NOs: 116-132, 134-138, 140-143, 145-175, 11664-11813, 11815, 11817-12050, 12052, 12054-12203, 13514, 13515, 13519, 13520, 14124-14141, 22759, 22764-22785, 22969-23184 or fragments or variants thereof;
C) 3'-UTR derived from a 3'-UTR of a muag gene as defined herein, preferably according to SEQ ID NO: 267 or 268, 22896-22901, 22906-22911;
D) poly(A) sequence comprising about 64 A nucleotides.
E) poly(C) sequence comprising about 10 to about 100 cytosines;
F) histone stem-loop selected from SEQ ID NOs: 178 or 179;

In preferred embodiments the nucleic acid, preferably the mRNA, comprises the following elements in 5'- to 3'-direction:

A) cap1 structure as defined herein;
B) 5'-UTR derived from a HSD17B4 gene as defined herein, preferably according to SEQ ID NO: 231 or 232;
C) coding sequence selected from SEQ ID NOs: 116-132, 134-138, 140-143, 145-175, 11664-11813, 11815, 11817-12050, 12052, 12054-12203, 13514, 13515, 13519, 13520, 14124-14141, 22759, 22764-22785, 22969-23184 or fragments or variants thereof;
D) 3'-UTR derived from a 3'-UTR of a PSMB3 gene as defined herein, preferably according to SEQ ID NO: 253 or 254;
E) poly(A) sequence comprising about 64 A nucleotides.
F) optionally a poly(C) sequence comprising about 10 to about 100 cytosines;
G) histone stem-loop selected from SEQ ID NOs: 178 or 179;

H) optionally, 3'-terminal sequence element SEQ ID NOs: 182-230.

In particularly preferred embodiments the nucleic acid, preferably the mRNA, comprises the following elements in 5'- to 3'-direction:
A) cap1 structure as defined herein;
B) 5'-UTR derived from a HSD17B4 gene as defined herein, preferably according to SEQ ID NO: 231 or 232;
C) coding sequence selected from SEQ ID NOs: 116-132, 134-138, 140-143, 145-175, 11664-11813, 11815, 11817-12050, 12052, 12054-12203, 13514, 13515, 13519, 13520, 14124-14141, 22759, 22764-22785, 22969-23184 or fragments or variants thereof;
D) 3'-UTR derived from a 3'-UTR of a PSMB3 gene as defined herein, preferably according to SEQ ID NO: 253 or 254;
E) a histone stem-loop selected from SEQ ID NOs: 178 or 179;
F) poly(A) sequence comprising about 100 A nucleotides, preferably representing the 3' terminus.

In further preferred embodiments the nucleic acid, preferably the mRNA, comprises the following elements in 5'- to 3'-direction:
A) cap1 structure as defined herein;
B) 5'-UTR derived from a HSD17B4 gene as defined herein, preferably according to SEQ ID NO: 231 or 232;
C) coding sequence selected from SEQ ID NOs: 116-132, 134-138, 140-143, 145-175, 11664-11813, 11815, 11817-12050, 12052, 12054-12203, 13514, 13515, 13519, 13520, 14124-14141, 22759, 22764-22785, 22969-23184 or fragments or variants thereof;
D) 3'-UTR derived from a 3'-UTR of a PSMB3 gene as defined herein, preferably according to SEQ ID NO: 253 or 254;
F) poly(A) sequence comprising about 100 A nucleotides, preferably representing the 3' terminus.

In further preferred embodiments the nucleic acid, preferably the mRNA, comprises the following elements in 5'- to 3'-direction:
A) cap1 structure as defined herein;
B) 5'-UTR derived from a SLC7A3 gene as defined herein, preferably according to SEQ ID NO: 245 or 246;
C) coding sequence selected from SEQ ID NOs: 116-132, 134-138, 140-143, 145-175, 11664-11813, 11815, 11817-12050, 12052, 12054-12203, 13514, 13515, 13519, 13520, 14124-14141, 22759, 22764-22785, 22969-23184 or fragments or variants thereof;
D) 3'-UTR derived from a 3'-UTR of a PSMB3 gene as defined herein, preferably according to SEQ ID NO: 253 or 254;
E) optionally a histone stem-loop selected from SEQ ID NOs: 178 or 179;
F) poly(A) sequence comprising about 100 A nucleotides, preferably representing the 3' terminus.

In further preferred embodiments the nucleic acid, preferably the mRNA, comprises the following elements in 5'- to 3'-direction:
A) cap1 structure as defined herein;
B) 5'-UTR derived from a RPL31 gene as defined herein, preferably according to SEQ ID NO: 243 or 243;
C) coding sequence selected from SEQ ID NOs: 116-132, 134-138, 140-143, 145-175, 11664-11813, 11815, 11817-12050, 12052, 12054-12203, 13514, 13515, 13519, 13520, 14124-14141, 22759, 22764-22785, 22969-23184 or fragments or variants thereof;
D) 3'-UTR derived from a 3'-UTR of a RPS9 gene as defined herein, preferably according to SEQ ID NO: 263 or 264;
E) optionally a histone stem-loop selected from SEQ ID NOs: 178 or 179;
F) poly(A) sequence comprising about 100 A nucleotides, preferably representing the 3' terminus.

Preferred nucleic acid sequences, preferably mRNA sequences of the invention are provided in Table 3a. Therein, each row represents a specific suitable SARS-CoV-2 (nCoV-2019) construct of the invention (compare with Table 1), wherein the description of the SARS-CoV-2 construct is indicated in column A of Table 3a and the SEQ ID NOs of the amino acid sequence of the respective SARS-CoV-2 construct is provided in column B. The corresponding SEQ ID NOs of the coding sequences encoding the respective SARS-CoV-2 constructs are provided in in Table 1. Further information is provided under <223> identifier of the respective SEQ ID NOs in the sequence listing.

The corresponding nucleic acid, preferably coding RNA sequences, in particular mRNA sequences comprising preferred coding sequences are provided in columns C and D, wherein column C provides nucleic acid sequences with an UTR combination "HSD17B4/PSMB3" as defined herein, wherein column D provides nucleic acid sequences with an "alpha-globin" 3' UTR as defined herein.

TABLE 3a

Nucleic acid, preferably mRNA constructs suitable for a coronavirus vaccine

| row | A | B | C | D |
|---|---|---|---|---|
| 1 | Full-length spike protein; S | 1-9, 274-340, 22737, 22739, 22741, 22743, 22745, 22747, 22749, 22751, 22753, 22755, 22757, 22929-22946 | 148, 155, 12204-12337, 12473-12540, 22791, 22793, 22795, 22797, 22799, 22801, 22803, 22805, 22807, 22809, 22811, 23409-23516 | 162, 169, 12676-12809, 12945-13012, 22818, 22820, 22822, 22824, 22826, 22828, 22830, 22832, 22834, 22836, 22838, 23189-23296 |
| 2 | Stabilized spike protein; S_stab_PP | 10-18, 341-407, 22738, 22740, 22742, 22744, 22746, 22748, 22750, 22752, 22754, 22756, 22758, 22947-22964 | 149-151, 156-158, 12338, 12541, 22792, 22794, 22796, 22798, 22800, 22802, 22804, 22806, 22808, 22810, 22812, 23517-23624 | 163-165, 170-172, 12810, 13013, 22819, 22821, 22823, 22825, 22827, 22829, 22831, 22833, 22835, 22837, 22839, 23297-23404 |

TABLE 3a-continued

Nucleic acid, preferably mRNA constructs suitable for a coronavirus vaccine

| row | A | B | C | D |
|---|---|---|---|---|
| 3 | Stabilized spike protein; S_stab_PP_cav | 408-541 | 12339, 12340, 12542, 12543 | 12811, 12812, 13014, 13015 |
| 4 | Stabilized spike protein; S_stab_PP_prot | 542-608 | 12341, 12544 | 12813, 13016 |
| 5 | Stabilized spike protein; S_stab_disul | 19-26, 609-1278, 13521-13587 | 12342-12351, 12545-12554, 14142, 14151 | 12814-12823, 13017-13026, 14160, 14169 |
| 6 | Spike protein fragment S1 | 27, 1279-1345 | 152-154, 159-161, 12352, 12555 | 166-168, 173-175, 12824, 13027 |
| 7 | S_woTM comprising a lumazine synthase | 58-66, 3624-3690 | 12353, 12556 | 12825, 13028 |
| 8 | S_stab_PP_woTM comprising a lumazine synthase | 85-93, 3691-3757 | 12354, 12557 | 12826, 13029 |
| 9 | S_stab_PP_cav_woTM comprising a lumazine synthase | 3758-3891 | 12355, 12356, 12558, 12559 | 12827, 12828, 13030, 13031 |
| 10 | S_stab_PP_prot_woTM comprising a lumazine synthase | 3892-3958 | 12357, 12560 | 12829, 13032 |
| 11 | S_stab_disul_woTM comprising a lumazine synthase | 3959-4628, 13588-13654 | 12358-12367, 12561-12570, 14143, 14152 | 12830-12839, 13033-13042, 14161, 14170 |
| 12 | S_woTM comprising a ferritin | 67-75, 4629-4695 | 12368, 12571 | 12840, 13043 |
| 13 | S_stab_PP_woTM comprising a ferritin | 94-102, 4696-4762 | 12369, 12572 | 12841, 13044 |
| 14 | S_stab_PP_cav_woTM comprising a ferritin | 4763-4896 | 12370, 12371, 12573, 12574 | 12842, 12843, 13045, 13046 |
| 15 | S_stab_PP_prot_woTM comprising a ferritin | 4897-4963 | 12372, 12575 | 12844, 13047 |
| 16 | S_stab_disul_woTM comprising a ferritin | 4964-5633, 13655-13721 | 12373-12382, 12576-12585, 14144, 14153 | 12845-12854, 13048-13057, 14162, 14171 |
| 17 | S_woTM comprising a foldon | 76-84, 5634-5700 | 12383, 12586 | 12855, 13058 |
| 18 | S_stab_PP_woTM comprising a foldon | 103-111, 5701-5767 | 12384, 12587 | 12856, 13059 |
| 19 | S_stab_PP_cav_woTM comprising a foldon | 5768-5901 | 12385, 12386, 12588, 12589 | 12857, 12858, 13060, 13061 |
| 20 | S_stab_PP_prot_woTM comprising a foldon | 5902-5968 | 12387, 12590 | 12859, 13062 |
| 21 | S_stab_disul_woTM comprising a foldon | 5969-6638, 13722-13788 | 12388-12397, 12591-12600, 14145, 14154 | 12860-12869, 13063-13072, 14163, 14172 |
| 22 | S_woTM comprising a WhcAg (VLP) | 6639-6705 | 12398, 12601 | 12870, 13073 |
| 23 | S_stab_PP_woTM comprising a WhcAg (VLP) | 6706-6772 | 12399, 12602 | 12871, 13074 |
| 24 | S_stab_PP_cav_woTM comprising a WhcAg (VLP) | 6773-6906 | 12400, 12401, 12603, 12604 | 12872, 12873, 13075, 13076 |
| 25 | S_stab_PP_prot_woTM comprising a WhcAg (VLP) | 6907-6973 | 12402, 12605 | 12874, 13077 |
| 26 | S_stab_disul_woTM comprising a WhcAg (VLP) | 6974-7643, 13789-13855 | 12403-12412, 12606-12615, 14146, 14155 | 12875-12884, 13078-13087, 14164, 14173 |
| 27 | S_woTMflex comprising a lumazine synthase | 7644-7710 | 12413, 12616 | 12885, 13088 |
| 28 | S_stab_PP_woTMflex comprising a lumazine synthase | 7711-7777 | 12414, 12617 | 12886, 13089 |
| 29 | S_stab_PP_cav_woTMflex comprising a lumazine synthase | 7778-7911 | 12415, 12416, 12618, 12619 | 12887, 12888, 13090, 13091 |
| 30 | S_stab_PP_prot_woTMflex comprising a lumazine synthase | 7912-7978 | 12417, 12620 | 12889, 13092 |
| 31 | S_stab_disul_woTMflex comprising a lumazine synthase | 7979-8648, 13856-13922 | 12418-12427, 12621-12630, 14147, 14156 | 12890-12899, 13093-13102, 14165, 14174 |
| 32 | S_woTMflex comprising a ferritin | 8649-8715 | 12428, 12631 | 12900, 13103 |
| 33 | S_stab_PP_woTMflex comprising a ferritin | 8716-8782 | 12429, 12632 | 12901, 13104 |
| 34 | S_stab_PP_cav_woTMflex comprising a ferritin | 8783-8916 | 12430, 12431, 12633, 12634 | 12902, 12903, 13105, 13106 |
| 35 | S_stab_PP_prot_woTMflex comprising a ferritin | 8917-8983 | 12432, 12635 | 12904, 13107 |
| 36 | S_stab_disul_woTMflex comprising a ferritin | 8984-9653, 13923-13989 | 12433-12442, 12636-12645, 14148, 14157 | 12905-12914, 13108-13117, 14166, 14175 |
| 37 | S_woTMflex comprising a foldon | 9654-9720 | 12443, 12646 | 12915, 13118 |
| 38 | S_stab_PP_woTMflex comprising a foldon | 9721-9787 | 12444, 12647 | 12916, 13119 |
| 39 | S_stab_PP_cav_woTMflex comprising a foldon | 9788-9921 | 12445, 12446, 12648, 12649 | 12917, 12918, 13120, 13121 |
| 40 | S_stab_PP_prot_woTMflex comprising a foldon | 9922-9988 | 12447, 12650 | 12919, 13122 |
| 41 | S_stab_disul_woTMflex comprising a foldon | 9989-10658, 13990-14056 | 12448-12457, 12651-12660, 14149, 14158 | 12920-12929, 13123-13132, 14167, 14176 |

TABLE 3a-continued

Nucleic acid, preferably mRNA constructs suitable for a coronavirus vaccine

| row | A | B | C | D |
|---|---|---|---|---|
| 42 | S_woTMflex comprising a WhcAg (VLP) | 10659-10725 | 12458, 12661 | 12930, 13133 |
| 43 | S_stab_PP_woTMflex comprising a WhcAg (VLP) | 10726-10792 | 12459, 12662 | 12931, 13134 |
| 44 | S_stab_PP_cav_woTMflex comprising a WhcAg (VLP) | 10793-10926 | 12460, 12461, 12663, 12664 | 12932, 12933, 13135, 13136 |
| 45 | S_stab_PP_prot_woTMflex comprising a WhcAg (VLP) | 10927-10993 | 12462, 12665 | 12934, 13137 |
| 46 | S_stab_disul_woTMflex comprising a WhcAg (VLP) | 10994-11663, 14057-14123 | 12463-12472, 12666-12675, 14150, 14159 | 12935-12944, 13138-13147, 14168, 14177 |
| 47 | Stabilized spike protein; S_stab_PP_hex | 22732 | 22786 | 22813 |
| 48 | RBD comprising a lumazyne synthase | 22735, 22736 | 22789, 22790 | 22816, 22817 |
| 49 | RBD comprising a ferritin | 22733 | 22787 | 22814 |
| 50 | RBD comprising a foldon | 22734 | 22788 | 22815 |

Further preferred nucleic acid sequences, preferably mRNA sequences of the invention are provided in Table 3b. Therein, each column represents a specific suitable SARS-CoV-2 (nCoV-2019) construct of the invention (compare with Table 1 and Table 3a), wherein column B represents "Full-length spike protein; S", row 1 of Table 1 and Table 3a and column C "Stabilized spike protein; S_stab_PP", compare with row 2 of Table 1 and Table 3a.

The SEQ ID NOs of the amino acid sequence of the respective SARS-CoV-2 construct are provided in row 1.

The corresponding SEQ ID NOs of the coding sequences encoding the respective SARS-CoV-2 constructs are provided in in Table 1. Further information is provided under <223> identifier of the respective SEQ ID NOs in the sequence listing.

The corresponding nucleic acid, preferably coding RNA sequences, in particular mRNA sequences comprising preferred coding sequences are provided in rows 2-16, wherein each row provides nucleic acid sequences with UTR combinations and suitable 3' ends.

TABLE 3b

Nucleic acid, preferably mRNA constructs suitable for a coronavirus vaccine

| row | A | B | C |
|---|---|---|---|
| 1 | Protein | 1-9, 274-340, 22737, 22739, 22741, 22743, 22745, 22747, 22749, 22751, 22753, 22755, 22757, 22929-22946 | 10-18, 341-407, 22738, 22740, 22742, 22744, 22746, 22748, 22750, 22752, 22754, 22756, 22758, 22947-22964 |
| 2 | RNA i-3 (A64-N5-C30-hSL-N5) | 162, 169, 12676-12809, 12945-13012, 22818, 22820, 22822, 22824, 22826, 22828, 22830, 22832, 22834, 22836, 22838, 23189-23296 | 163-165, 170-172, 12810, 13013, 22819, 22821, 22823, 22825, 22827, 22829, 22831, 22833, 22835, 22837, 22839, 23297-23404 |
| 3 | RNA a-1 (hSL-A100) | 148, 155, 12204-12337, 12473-12540, 22791, 22793, 22795, 22797, 22799, 22801, 22803, 22805, 22807, 22809, 22811, 23409-23516 | 149-151, 156-158, 12338, 12541, 22792, 22794, 22796, 22798, 22800, 22802, 22804, 22806, 22808, 22810, 22812, 23517-23624 |
| 4 | RNA a-3 (hSL-A100) | 23629-23736 | 23737-23844 |
| 5 | RNA e-2 (hSL-A100) | 23849-23956 | 23957-24064 |
| 6 | RNA i-3 (hSL-A100) | 24069-24176, 24289-24396, 24509-24616 | 24177-24284, 24397-24504, 24617-24724 |
| 7 | RNA a-1 (A100) | 24729-24836 | 24837-24944 |
| 8 | RNA a-3 (A100) | 24949-25056 | 25057-25164 |
| 9 | RNA e-2 (A100) | 25169-25276 | 25277-25384 |
| 10 | RNA i-3 (A100) | 25389-25496, 25609-25716, 25829-25936 | 25497-25604, 25717-25824, 25937-26044 |
| 13 | RNA x-1 (A100) | 26049-26156 | 26157-26264 |
| 14 | RNA x-2 (A100) | 26269-26376 | 26377-26484 |
| 15 | RNA x-1 (A100-N5) | 26489-26596 | 26597-26704 |
| 16 | RNA x-2 (A30-N10-A70) | 26709-26816 | 26817-26924 |

In preferred embodiments, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 148-175, 12204-13147, 14142-14177, 22786-22839, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 or a fragment or variant of any of these sequences. Further information regarding respective nucleic acid sequences is provided under <223> identifier of the respective SEQ ID NO in the sequence listing, and in Table 3a (see in particular Column C and D) and Table 3b (see in particular rows 2-16).

In particularly preferred embodiments, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 162-175, 12676-13147, 14160-14177, 22786-22839, 23189-23404, or a fragment or variant of any of these sequences. Further information regarding respective nucleic acid sequences is provided under <223> identifier of the respective SEQ ID NO in the sequence listing, and in Table 3a (see in particular Column D), Table 3b (row 2).

In particularly preferred embodiments, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 148-161, 12204-12675, 14142-14159, 22786-22812, 23409-23624, 24729-24944, or a fragment or variant of any of these sequences. Further information regarding respective nucleic acid sequences is provided under <223> identifier of the respective SEQ ID NO in the sequence listing, and in Table 3a (see in particular Column C) and Table 3b (see rows 3, 7).

In particularly preferred embodiments, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 149-154, 156-161, 163-168, 170-175, 12338, 12352, 12541, 12555, 12810, 12824, 13013, 13027, 22786, 22792, 22794, 22796, 22798, 22800, 22802, 22804, 22806, 22808, 22810, 22812, 22813, 22819, 22821, 22823, 22825, 22827, 22829, 22831, 22833, 22835, 22837, 22839, 23517-23624, 23297-23404, 24837-24944 or a fragment or variant of any of these sequences. Further information regarding respective nucleic acid sequences is provided under <223> identifier of the respective SEQ ID NO in the sequence listing and in Table 3a (see Column C and D, rows 2 and 6) and Table 3b (see Column C).

In even more preferred embodiments, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 149, 156, 12338, 150, 157, 151, 158, 12541, 163, 170, 12810, 164, 171, 165, 172, 13013, 12342-12351, 12545-12554, 12814-12823, 13017-13026, 14133 or a fragment or variant of any of these sequences. Further information regarding respective nucleic acid sequences is provided under <223> identifier of the respective SEQ ID NO in the sequence listing and in Table 3a and 3b.

In even more preferred embodiments, the nucleic acid, preferably the RNA, comprises or consists of a nucleic acid sequence selected from the group consisting of SEQ ID NOs: 149, 150, 151, 163, 164, 165 or a fragment or variant of any of these sequences. Further information regarding respective nucleic acid sequences is provided under <223> identifier of the respective SEQ ID NO in the sequence listing and in Table 3 (see Column C and D, row 2).

In a particularly preferred embodiment, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 163.

In a further particularly preferred embodiment, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 149.

In a further particularly preferred embodiment, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 24837.

In a further preferred embodiment, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 23311, 23531, 24851.

In a further preferred embodiment, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 23310, 23530, 24850.

In a further preferred embodiment, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 23313, 23533, 24853, 23314, 23534, 24854.

In a further embodiment, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 26633.

In a further embodiment, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 26907.

In further preferred embodiments, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 148-175, 12204-13147, 14142-14177, 22786-22839, 23189-23404, 23409-23624, 23629-23844, 23849-24064, 24069-

24284, 24289-24504, 24509-24724, 24729-24944, 24949-25164, 25169-25384, 25389-25604, 25609-25824, 25829-26044, 26049-26264, 26269-26484, 26489-26704, 26709-26937, wherein said RNA sequences comprise a cap1 structure as defined herein. Further information regarding respective nucleic acid sequences is provided under <223> identifier of the respective SEQ ID NO in the sequence listing and in Table 3a and 3b.

In further embodiments, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 148-175, 12204-13147, 14142-14177, 22786-22839, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937, wherein at least one, preferably all uracil nucleotides in said RNA sequences are replaced by pseudouridine (ψ) nucleotides and/or N1-methylpseudouridine (m1ψ) nucleotides. Further information regarding respective nucleic acid sequences is provided under <223> identifier of the respective SEQ ID NO in the sequence listing and in Table 3a and 3b.

In further embodiments, the nucleic acid, preferably the RNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 148-175, 12204-13147, 14142-14177, 22786-22839, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937, wherein said RNA sequences comprise a cap1 structure as defined herein, and, wherein at least one, preferably all uracil nucleotides in said RNA sequences are replaced by pseudouridine (ψ) nucleotides and/or N1-methylpseudouridine (m1ψ) nucleotides. Further information regarding respective nucleic acid sequences is provided under <223> identifier of the respective SEQ ID NO in the sequence listing and in Table 3a and 3b.

As outlined throughout the specification, additional information regarding suitable amino acid sequences or nucleic acid sequences (coding sequences, DNA sequences, RNA sequences) may also be derived from the sequence listing, in particular from the details provided therein under identifier <223> as explained in the following.

In particular embodiments, the nucleic acid of the invention is an RNA, wherein the RNA may be prepared using any method known in the art, including chemical synthesis such as e.g. solid phase RNA synthesis, as well as in vitro methods, such as RNA in vitro transcription reactions. Accordingly, in a preferred embodiment, the RNA is obtained by RNA in vitro transcription.

Accordingly, in preferred embodiments, the nucleic acid of the invention is preferably an in vitro transcribed RNA. The terms "RNA in vitro transcription" or "in vitro transcription" relate to a process wherein RNA is synthesized in a cell-free system (in vitro). RNA may be obtained by DNA-dependent in vitro transcription of an appropriate DNA template, which according to the present invention is a linearized plasmid DNA template or a PCR-amplified DNA template. The promoter for controlling RNA in vitro transcription can be any promoter for any DNA-dependent RNA polymerase. Particular examples of DNA-dependent RNA polymerases are the T7, T3, SP6, or Syn5 RNA polymerases. In a preferred embodiment of the present invention the DNA template is linearized with a suitable restriction enzyme, before it is subjected to RNA in vitro transcription.

Reagents used in RNA in vitro transcription typically include: a DNA template (linearized plasmid DNA or PCR product) with a promoter sequence that has a high binding affinity for its respective RNA polymerase such as bacteriophage-encoded RNA polymerases (T7, T3, SP6, or Syn5); ribonucleotide triphosphates (NTPs) for the four bases (adenine, cytosine, guanine and uracil); optionally, a cap analogue as defined herein; optionally, further modified nucleotides as defined herein; a DNA-dependent RNA polymerase capable of binding to the promoter sequence within the DNA template (e.g. T7, T3, SP6, or Syn5 RNA polymerase); optionally, a ribonuclease (RNase) inhibitor to inactivate any potentially contaminating RNase; optionally, a pyrophosphatase to degrade pyrophosphate, which may inhibit RNA in vitro transcription; MgCl2, which supplies Mg2+ ions as a co-factor for the polymerase; a buffer (TRIS or HEPES) to maintain a suitable pH value, which can also contain antioxidants (e.g. DTT), and/or polyamines such as spermidine at optimal concentrations, e.g. a buffer system comprising TRIS-Citrate as disclosed in WO2017/109161.

In preferred embodiments, the cap1 structure of the RNA of the invention is formed using co-transcriptional capping using tri-nucleotide cap analogues m7G(5')ppp(5')(2'OMeA)pG or m7G(5')ppp(5')(2'OMeG)pG. A preferred cap1 analogue that may suitably be used in manufacturing the coding RNA of the invention is m7G(5')ppp(5')(2'OMeA)pG.

In a particularly preferred embodiment, the cap1 structure of the RNA of the invention is formed using co-transcriptional capping using tri-nucleotide cap analogue 3'OMe-m7G(5')ppp(5')(2'OMeA)pG.

In other embodiments, a capO structure of the RNA of the invention is formed using co-transcriptional capping using cap analogue 3'OMe-m7G(5')ppp(5')G.

In additional embodiments, the nucleotide mixture used in RNA in vitro transcription may additionally comprise modified nucleotides as defined herein. In that context, preferred modified nucleotides may be selected from pseudouridine (ψ), N1-methylpseudouridine (m1ψ), 5-methylcytosine, and 5-methoxyuridine. In particular embodiments, uracil nucleotides in the nucleotide mixture are replaced (either partially or completely) by pseudouridine (ψ) and/or N1-methylpseudouridine (m1ψ) to obtain a modified RNA.

In preferred embodiments, the nucleotide mixture used in RNA in vitro transcription does not comprise modified nucleotides as defined herein. In preferred embodiments, the nucleotide mixture used in RNA in vitro transcription does only comprise G, C, A and U nucleotides, and, optionally, a cap analog as defined herein.

In preferred embodiments, the nucleotide mixture (i.e. the fraction of each nucleotide in the mixture) used for RNA in vitro transcription reactions may be optimized for the given RNA sequence, preferably as described WO2015/188933. In this context the in vitro transcription has been performed in the presence of a sequence optimized nucleotide mixture and optionally a cap analog, preferably wherein the sequence optimized nucleotide mixture does not comprise chemically modified nucleotides.

In this context a sequence-optimized nucleoside triphosphate (NTP) mix is a mixture of nucleoside triphosphates (NTPs) for use in an in vitro transcription reaction of an RNA molecule of a given sequence comprising the four nucleoside triphosphates (NTPs) GTP, ATP, CTP and UTP, wherein the fraction of each of the four nucleoside triphosphates (NTPs) in the sequence-optimized nucleoside triphosphate (NTP) mix corresponds to the fraction of the respective nucleotide in said RNA molecule. If a ribonucleotide is not present in the RNA molecule, the corresponding nucleoside triphosphate is also not present in the sequence-optimized nucleoside triphosphate (NTP) mix.

In embodiments where more than one different RNA as defined herein have to be produced, e.g. where 2, 3, 4, 5, 6, 7, 8, 9, 10 or even more different RNAs have to be produced (see second aspect), procedures as described in WO2017/109134 may suitably be used.

In the context of nucleic acid-based vaccine production, it may be required to provide GMP-grade nucleic acids, e.g. a GMP grade RNA or DNA. GMP-grade RNA or DNA may be produced using a manufacturing process approved by regulatory authorities. Accordingly, in a particularly preferred embodiment, RNA production is performed under current good manufacturing practice (GMP), implementing various quality control steps on DNA and RNA level, preferably according to WO2016/180430. In preferred embodiments, the RNA of the invention is a GMP-grade RNA, particularly a GMP-grade mRNA. Accordingly, an RNA for a vaccine is preferably a GMP grade RNA.

The obtained RNA products are preferably purified using PureMessenger® (CureVac, Tubingen, Germany; RP-HPLC according to WO2008/077592) and/or tangential flow filtration (as described in WO2016/193206) and/or oligo d(T) purification (see WO2016/180430).

Preferably, the RNA according to the invention is purified using RP-HPLC, preferably using Reversed-Phase High pressure liquid chromatography (RP-HPLC) with a macroporous styrene/divinylbenzene column (e.g. particle size 30 μm, pore size 4000 A and additionally using a filter cassette with a cellulose based membrane with a molecular weight cutoff of about 100 kDa.

In this context it is particularly preferred that the purified RNA has been purified by RP-HPLC and/or TFF which results in about 5%, 10%, or 20% less double stranded RNA side products as in RNA that has not been purified with RP-HPLC and/or TFF.

Alternatively, the purified RNA that has been purified by RP-HPLC and/or TFF comprises about 5%, 10%, or 20% less double stranded RNA side products as an RNA that has been purified with Oligo dT purification, precipitation, filtration and/or anion exchange chromatography.

In a further preferred embodiment, the nucleic acid, preferably the RNA, is lyophilized (e.g. according to WO2016/165831 or WO2011/069586) to yield a temperature stable dried nucleic acid (powder) as defined herein (e.g. RNA or DNA). The nucleic acid of the invention, particularly the RNA may also be dried using spray-drying or spray-freeze drying (e.g. according to WO2016/184575 or WO2016/184576) to yield a temperature stable RNA (powder) as defined herein. Accordingly, in the context of manufacturing and purifying nucleic acid, in particular RNA, the disclosures of WO2017/109161, WO2015/188933, WO2016/180430, WO2008/077592, WO2016/193206, WO2016/165831, WO2011/069586, WO2016/184575, and WO2016/184576 are incorporated herewith by reference.

Accordingly, in preferred embodiments, the nucleic acid is a dried nucleic acid, particularly a dried RNA.

The term "dried RNA" as used herein has to be understood as RNA that has been lyophilized, or spray-dried, or spray-freeze dried as defined above to obtain a temperature stable dried RNA (powder).

In preferred embodiments, the nucleic acid of the invention is a purified nucleic acid, particularly a purified RNA.

The term "purified nucleic acid" as used herein has to be understood as nucleic acid which has a higher purity after certain purification steps than the starting material. Typical impurities that are essentially not present in purified nucleic acid comprise peptides or proteins, spermidine, BSA, abortive nucleic acid sequences, nucleic acid fragments, free nucleotides, bacterial impurities, or impurities derived from purification procedures. Accordingly, it is desirable in this regard for the "degree of nucleic acid purity" to be as close as possible to 100%. It is also desirable for the degree of nucleic acid purity that the amount of full-length nucleic acid is as close as possible to 100%. Accordingly "purified nucleic acid" as used herein has a degree of purity of more than 75%, 80%, 85%, very particularly 90%, 91%, 92%, 93%, 94%, 95%, 96%, 97%, 98% and most favorably 99% or more. The degree of purity may for example be determined by an analytical HPLC, wherein the percentages provided above correspond to the ratio between the area of the peak for the target nucleic acid and the total area of all peaks representing the by-products. Alternatively, the degree of purity may for example be determined by an analytical agarose gel electrophoresis or capillary gel electrophoresis.

In preferred embodiments, the nucleic acid of the invention is a purified RNA.

The term "purified RNA" or "purified mRNA" as used herein has to be understood as RNA which has a higher purity after certain purification steps (e.g. HPLC, TFF, Oligo d(T) purification, precipitation steps) than the starting material (e.g. in vitro transcribed RNA). Typical impurities that are essentially not present in purified RNA comprise peptides or proteins (e.g. enzymes derived from DNA dependent RNA in vitro transcription, e.g. RNA polymerases, RNases, pyrophosphatase, restriction endonuclease, DNase), spermidine, BSA, abortive RNA sequences, RNA fragments (short double stranded RNA fragments, abortive sequences etc.), free nucleotides (modified nucleotides, conventional NTPs, cap analogue), template DNA fragments, buffer components (HEPES, TRIS, MgCl2) etc. Other potential impurities that may be derived from e.g. fermentation procedures comprise bacterial impurities (bioburden, bacterial DNA) or impurities derived from purification procedures (organic solvents etc.). Accordingly, it is desirable in this regard for the "degree of RNA purity" to be as close as possible to 100%. It is also desirable for the degree of RNA purity that the amount of full-length RNA transcripts is as close as possible to 100%. Accordingly, "purified RNA" as used herein has a degree of purity of more than 75%, 80%, 85%, very particularly 90%, 91%, 92%, 93%, 94%, 95%, 96%, 97%, 98% and most favorably 99% or more. The degree of purity may for example be determined by an analytical HPLC, wherein the percentages provided above correspond to the ratio between the area of the peak for the target RNA and the total area of all peaks representing the by-products. Alternatively, the degree of purity may for example be determined by an analytical agarose gel electrophoresis or capillary gel electrophoresis.

In particularly preferred embodiments where the nucleic acid is an RNA, the RNA has been purified by RP-HPLC and/or TFF to remove double-stranded RNA, non-capped RNA and/or RNA fragments.

The formation of double stranded RNA as side products during e.g. RNA in vitro transcription can lead to an induction of the innate immune response, particularly IFNalpha which is the main factor of inducing fever in vaccinated subjects, which is of course an unwanted side effect. Current techniques for immunoblotting of dsRNA (via dot Blot, serological specific electron microscopy (SSEM) or ELISA for example) are used for detecting and sizing dsRNA species from a mixture of nucleic acids.

Suitably, the RNA of the invention has been purified by RP-HPLC and/or TFF as described herein to reduce the amount of dsRNA.

In preferred embodiments, the RNA of the invention comprises about 5%, 10%, or 20% less double stranded RNA side products as an RNA that has not been purified with RP-HPLC and/or TFF.

In preferred embodiments, the RP-HPLC and/or TFF purified RNA of the invention comprises about 5%, 10%, or 20% less double stranded RNA side products as an RNA that has been purified with Oligo dT purification, precipitation, filtration and/or AEX.

It has to be understood that "dried RNA" as defined herein and "purified RNA" as defined herein or "GMP-grade RNA" as defined herein may have superior stability characteristics (in vitro, in vivo) and improved efficiency (e.g. better translatability of the mRNA in vivo) and are therefore particularly suitable for a medical purpose, e.g. a vaccine.

Following co-transcriptional capping as defined herein, and following purification as defined herein, the capping degree of the obtained RNA may be determined using capping assays as described in published PCT application WO2015/101416, in particular, as described in claims 27 to 46 of published PCT application WO2015/101416 can be used. Alternatively, a capping assays described in PCT/EP2018/08667 may be used.

In embodiments, an automated device for performing RNA in vitro transcription may be used to produce and purify the nucleic acid of the invention. Such a device may also be used to produce the composition or the vaccine (see aspects 2 and 3). Preferably, a device as described in WO2020002598, in particular, a device as described in claims 1 to 59 and/or 68 to 76 of WO2020002598 (and FIGS. 1-18) may suitably be used.

The methods described herein may preferably applied to a method of producing an RNA composition or vaccine as described in further detail below.

Composition, Pharmaceutical Composition:

A second aspect relates to a composition comprising at least one nucleic acid of the first aspect.

Notably, embodiments relating to the composition of the second aspect may likewise be read on and be understood as suitable embodiments of the vaccine of the fourth aspect. Also, embodiments relating to the vaccine of the fourth aspect may likewise be read on and be understood as suitable embodiments of the composition of the second aspect (comprising the nucleic acid of the first aspect). Furthermore, features and embodiments described in the context of the first aspect (the nucleic acid of the invention) have to be read on and have to be understood as suitable embodiments of the composition of the second aspect.

In preferred embodiments, the composition comprises at least one nucleic acid according to the first aspect encoding at least one antigenic peptide or protein that is or is derived from a SARS-CoV-2 (formerly an nCoV-2019) coronavirus, or an immunogenic fragment or immunogenic variant thereof.

In preferred embodiments, the composition comprises at least one nucleic acid encoding at least one antigenic peptide or protein that is or is derived from a SARS-CoV-2 coronavirus, or an immunogenic fragment or immunogenic variant thereof according to the first aspect, wherein said composition is to be, preferably, administered intramuscularly or intradermal.

Preferably, intramuscular or intradermal administration of said composition results in expression of the encoded SARS-CoV-2 antigen construct in a subject. In embodiments where the nucleic acid is an RNA, administration of said composition results in translation of the RNA and to a production of the encoded SARS-CoV-2 antigen in a subject. In embodiments where the nucleic acid is a DNA (e.g. plasmid DNA, adenovirus DNA), administration of said composition results in transcription of the DNA into RNA, and to a subsequent translation of the RNA into the encoded SARS-CoV-2 coronavirus antigen in a subject.

Preferably, the composition of the second aspect is suitable for a vaccine, in particular, suitable for a coronavirus vaccine, preferably a SARS-CoV-2 (nCoV-2019) vaccine.

In the context of the invention, a "composition" refers to any type of composition in which the specified ingredients (e.g. nucleic acid encoding at least one antigenic peptide or protein that is or is derived from a SARS-CoV-2 coronavirus, e.g. an RNA or a DNA, e.g. in association with a polymeric carrier or LNP) may be incorporated, optionally along with any further constituents, usually with at least one pharmaceutically acceptable carrier or excipient. The composition may be a dry composition such as a powder or granules, or a solid unit such as a lyophilized form. Alternatively, the composition may be in liquid form, and each constituent may be independently incorporated in dissolved or dispersed (e.g. suspended or emulsified) form.

In a preferred embodiment of the second aspect, the composition comprises at least one nucleic acid (e.g. DNA or RNA) of the first aspect, preferably an RNA, and optionally, at least one pharmaceutically acceptable carrier or excipient.

In embodiments of the second aspect, the composition comprises at least one nucleic acid of the first aspect, preferably a plasmid DNA, adenovirus DNA, and optionally, at least one pharmaceutically acceptable carrier or excipient.

In preferred embodiments of the second aspect, the composition comprises at least one nucleic acid (e.g. DNA or RNA), preferably an RNA, wherein the nucleic acid comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 116-132, 134-138, 140-143, 145-175, 11664-11813, 11815, 11817-12050, 12052, 12054-13147, 13514, 13515, 13519, 13520, 14124-14177, 22759, 22764-22786, 22791-22813, 22818-22839, 22969-23184, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 and, optionally, at least one pharmaceutically acceptable carrier or excipient.

In particularly preferred embodiments of the second aspect, the composition comprises at least one nucleic acid (e.g. DNA or RNA), preferably an RNA, wherein the nucleic acid comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 148-175, 12204-13147, 14142-14177, 22786-22839, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 and, optionally, at least one pharmaceutically acceptable carrier or excipient.

Most preferably the composition comprises at least one nucleic acid (e.g. DNA or RNA), preferably an RNA, wherein the nucleic acid comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO. 163.

Most preferably the composition comprises at least one nucleic acid (e.g. DNA or RNA), preferably an RNA, wherein the nucleic acid comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO. 149.

In further particularly preferred embodiments, the composition comprises at least one nucleic acid (e.g. DNA or RNA), preferably an RNA, wherein the nucleic acid comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO. 24837, 23311, 23531, 23310, 23530, 23313, 23533.

In further embodiments, the composition comprises at least one nucleic acid (e.g. DNA or RNA), preferably an RNA, wherein the nucleic acid comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO. 26633, 26907.

In particularly preferred embodiments of the second aspect, the composition comprises at least one nucleic acid (e.g. DNA or RNA), preferably an RNA, wherein the nucleic acid comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 149-151, 163-165, 24837, 23311, 23531, 24851, 23310, 23530, 23313, 23533 and, optionally, at least one pharmaceutically acceptable carrier or excipient.

The term "pharmaceutically acceptable carrier" or "pharmaceutically acceptable excipient" as used herein preferably includes the liquid or non-liquid basis of the composition for administration. If the composition is provided in liquid form, the carrier may be water, e.g. pyrogen-free water; isotonic saline or buffered (aqueous) solutions, e.g. phosphate, citrate etc. buffered solutions. Water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to preferred embodiments, the sodium, calcium and, optionally, potassium salts may occur in the form of their halogenides, e.g. chlorides, iodides, or bromides, in the form of their hydroxides, carbonates, hydrogen carbonates, or sulfates, etc. Examples of sodium salts include NaCl, NaI, NaBr, $Na_2CO_3$, $NaHCO_3$, $Na_2SO_4$, examples of the optional potassium salts include KCl, KI, KBr, $K_2CO_3$, $KHCO_3$, $K_2SO_4$, and examples of calcium salts include $CaCl_2$), $CaI_2$, $CaBr_2$, $CaCO_3$, $CaSO_4$, $Ca(OH)_2$.

Furthermore, organic anions of the aforementioned cations may be in the buffer. Accordingly, in embodiments, the nucleic acid composition may comprise pharmaceutically acceptable carriers or excipients using one or more pharmaceutically acceptable carriers or excipients to e.g. increase stability, increase cell transfection, permit the sustained or delayed, increase the translation of encoded coronavirus protein in vivo, and/or alter the release profile of encoded coronavirus protein in vivo. In addition to traditional excipients such as any and all solvents, dispersion media, diluents, or other liquid vehicles, dispersion or suspension aids, surface active agents, isotonic agents, thickening or emulsifying agents, preservatives, excipients of the present invention can include, without limitation, lipidoids, liposomes, lipid nanoparticles, polymers, lipoplexes, core-shell nanoparticles, peptides, proteins, cells transfected with polynucleotides, hyaluronidase, nanoparticle mimics and combinations thereof. In embodiments, one or more compatible solid or liquid fillers or diluents or encapsulating compounds may be used as well, which are suitable for administration to a subject. The term "compatible" as used herein means that the constituents of the composition are capable of being mixed with the at least one nucleic acid and, optionally, a plurality of nucleic acids of the composition, in such a manner that no interaction occurs, which would substantially reduce the biological activity or the pharmaceutical effectiveness of the composition under typical use conditions (e.g., intramuscular or intradermal administration). Pharmaceutically acceptable carriers or excipients must have sufficiently high purity and sufficiently low toxicity to make them suitable for administration to a subject to be treated. Compounds which may be used as pharmaceutically acceptable carriers or excipients may be sugars, such as, for example, lactose, glucose, trehalose, mannose, and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from *theobroma*; polyols, such as, for example, polypropylene glycol, glycerol, sorbitol, mannitol and polyethylene glycol; alginic acid.

The at least one pharmaceutically acceptable carrier or excipient of the composition may preferably be selected to be suitable for intramuscular or intradermal delivery/administration of said composition. Accordingly, the composition is preferably a pharmaceutical composition, suitably a composition for intramuscular administration.

Subjects to which administration of the compositions, preferably the pharmaceutical composition, is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Pharmaceutical compositions of the present invention may suitably be sterile and/or pyrogen-free.

Multivalent Compositions of the Invention:

In embodiments, the composition (e.g. multivalent composition) as defined herein may comprise a plurality or at least more than one of the nucleic acid species, e.g. RNA species as defined in the context of the first aspect of the invention. Preferably, the composition as defined herein may comprise 2, 3, 4, 5, 6, 7, 8, 9, or 10 different nucleic acids each defined in the context of the first aspect.

In embodiments, the composition (e.g. multivalent composition) may comprise at least 2, 3, 4, 5, 6, 7, 8, 9, 10 or even more different nucleic acid species as defined in the context of the first aspect, each encoding at least one antigenic peptide or protein derived from the same coronavirus, or a fragment or variant thereof. Particularly, said (genetically) same coronavirus expresses (essentially) the same repertoire of proteins or peptides, wherein all proteins or peptides have (essentially) the same amino acid sequence. Particularly, said (genetically) same coronavirus expresses essentially the same proteins, peptides or polyproteins, wherein these protein, peptide or polyproteins preferably do not differ in their amino acid sequence(s).

In embodiments, the composition (e.g. multivalent composition) comprises at least 2, 3, 4, 5, 6, 7, 8, 9, 10 or even more different nucleic acid species as defined in the context of the first aspect, each encoding at least one peptide or protein derived from a genetically different coronavirus (e.g. a different coronavirus isolate), or a fragment or variant thereof. The terms "different" or "different coronavirus" as used throughout the present specification have to be understood as the difference between at least two respective coronavirus (e.g. a different coronavirus isolates), wherein the difference is manifested on the genome of the respective different coronavirus. Particularly, said (genetically) different coronavirus may express at least one different protein, peptide or polyprotein, wherein the at least one different protein, peptide or polyprotein differs in at least one amino acid.

In preferred embodiments the plurality or at least more than one of the nucleic acid sequences of the multivalent composition each encode a different spike protein, preferably a prefusion stabilized spike protein.

In this context it is particularly preferred that the different spike proteins or prefusion stabilized spike proteins are derived from different SARS-CoV-2 virus variants/isolates, wherein it is particularly preferred that the spike proteins are derived from B.1.1.7, B.1.351, P.1, or CAL.20C.

In this context it is further preferred that the different spike proteins or prefusion stabilized spike proteins have amino acid changes in the spike protein comprising:
  (i) delH69, delV70, Y453F, D614G, I692V and M1229I;
  (ii) delH69, delV70, delY144, N501Y, A570D, D614G, P681H, T716I, S982A and D1118H;
  (iii) L18F, D80A, D215G, delL242, delA243, delL244, R246I, K417N, E484K, N501Y, D614G and A701V;
  (iv) L18F, T20N, P26S, D138Y, R190S, K417T, E484K, N501Y, D614G, H655Y and T1027I; and/or
  (v) S13I, W152C, L452R, and D614G.

In embodiments, the composition (e.g. multivalent composition) comprises 2, 3, 4 or 5 nucleic acid species (e.g. DNA or RNA), preferably RNA species, wherein said nucleic acid species comprise or consist of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 116-132, 134-138, 140-143, 145-175, 11664-11813, 11815, 11817-12050, 12052, 12054-13147, 13514, 13515, 13519, 13520, 14124-14177, 22759, 22764-22786, 22791-22813, 22818-22839, 22969-23184, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 and, optionally, at least one pharmaceutically acceptable carrier or excipient, wherein each of the 2, 3, 4 or 5 nucleic acid species encode a different antigenic peptide or protein of a SARS-CoV-2 coronavirus.

Accordingly, in embodiments, the composition (e.g. multivalent composition) comprises two nucleic acid species (e.g. DNA or RNA), preferably RNA species, wherein the nucleic acid species comprise or consist of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 148-175, 12204-13147, 14142-14177, 22786-22839, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 and, optionally, at least one pharmaceutically acceptable carrier or excipient, wherein each of the two nucleic acid species encode a different antigenic peptide or protein of a SARS-CoV-2 coronavirus.

In embodiments, the composition (e.g. multivalent composition) comprises three nucleic acid species (e.g. DNA or RNA), preferably RNA species, wherein the nucleic acid comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 148-175, 12204-13147, 14142-14177, 22786-22839, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 and, optionally, at least one pharmaceutically acceptable carrier or excipient, wherein each of the 2, 3, 4 or 5 nucleic acid species encode a different antigenic peptide or protein of a SARS-CoV-2 coronavirus.

In the following, particularly preferred embodiments of a multivalent composition are provided.

Preferably, the at least 2, 3, 4, 5, 6, 7, 8, 9, 10 or even more different nucleic acid species of the multivalent composition each encode a different prefusion stabilized spike protein (as defined in the first aspect). Preferably, stabilization of the prefusion conformation is obtained by introducing two consecutive proline substitutions at residues K986 and V987 in the spike protein (Amino acid positions according to reference SEQ ID NO: 1). Accordingly, in preferred embodiments, the at least 2, 3, 4, 5, 6, 7, 8, 9, 10 pre-fusion stabilized spike proteins (S_stab) each comprises at least one prefusion stabilizing mutation, wherein the at least one prefusion stabilizing mutation comprises the following amino acid substitutions: K986P and V987P (amino acid positions according to reference SEQ ID NO: 1).

Accordingly, the at least 2, 3, 4, 5, 6, 7, 8, 9, 10 or even more different nucleic acid species of the multivalent composition each encode a different prefusion stabilized spike protein, wherein the at least 2, 3, 4, 5, 6, 7, 8, 9, 10 or even more stabilized spike proteins are selected from amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10-26, 341-407, 609-1278, 13521-13587, 22738, 22740, 22742, 22744, 22746, 22748, 22750, 22752, 22754, 22756, 22758, 22947-22964 or an immunogenic fragment or immunogenic variant of any of these.

83

In preferred embodiments, the multivalent composition comprises one nucleic acid species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10, wherein the multivalent composition additionally comprises at least 2, 3, 4 further RNA species selected from i) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22961; and/or ii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22960; and/or iii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22963; and/or iv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22941; and/or v) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22964.

In preferred embodiments, the multivalent composition comprises at least two nucleic acid species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10, 22961; 22960, 22963, 22941, 22964.

Preferably, the at least 2, 3, 4, 5, 6, 7, 8, 9, 10 or even more different nucleic acid species of the multivalent composition comprise nucleic acid coding sequences each encoding a different prefusion stabilized spike protein, wherein the at least 2, 3, 4, 5, 6, 7, 8, 9, 10 or even more nucleic acid coding sequences are selected from nucleic acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 136-138, 140-143, 145-175, 11731-11813, 11815, 11817-12050, 12052, 12054-12203, 13514, 13515, 13519, 13520, 14124-14141, 22759, 22764-22785, 22969-23184 or fragments or variants of any of these.

In preferred embodiments, the multivalent composition comprises one nucleic acid species comprising a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 137, wherein the multivalent composition additionally comprises at least 2, 3, 4 further RNA species selected from i) one nucleic acid species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23091; and/or ii) one nucleic acid species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23090; and/or iii) one nucleic acid species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23093; and/or iv) one nucleic acid species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22999; and/or v) one nucleic acid species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23094.

Preferably, the at least 2, 3, 4, 5, 6, 7, 8, 9, 10 or even more different nucleic acid species of the multivalent composition comprise nucleic acid coding sequences each encoding a different prefusion stabilized spike protein, wherein the at least 2, 3, 4, 5, 6, 7, 8, 9, 10 or even more nucleic acid coding sequences are selected from RNA sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 149-151, 163-165, 12338, 12541, 12810-12813, 12901, 12931, 13013, 22792, 22794, 22796, 22798, 22802, 22804, 22806, 22810, 22813, 22819, 22821, 22823, 22825, 22827, 22829, 22831, 22833, 22835, 22837, 22839, 23297-23314, 23369, 23517-23520, 23523-23525, 23527, 23529, 23530, 23589, 23737, 23957, 24397, 24837, 25057, 25277, 25717, 26925-26937 or fragments or variants of any of these.

In preferred embodiments, the multivalent composition comprises one RNA species comprising or consisting of an RNA sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 163, wherein the multivalent composition additionally comprises at least 2, 3, 4 further RNA species selected from i) one RNA species comprising or consisting of an RNA sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23311; and/or ii) one RNA species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23310; and/or iii) one RNA species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23313; and/or iv) one RNA species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: SEQ ID NO: 23219; and/or v) one RNA species comprises a coding sequence identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23314;

wherein, preferably, each of the mRNA species comprise a Cap1 structure, and, optionally, each of the mRNA species do not comprise modified nucleotides.

In preferred embodiments, the multivalent composition comprises one RNA species comprising or consisting of an RNA sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 149 or 24837, wherein the multivalent composition additionally comprises at least 2, 3, 4 further RNA species selected from
  i) one RNA species comprising or consisting of an RNA sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23531 or 24851; and/or one RNA species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23530 or 24850; and/or
  iii) one RNA species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23533 or 24853; and/or
  iv) one RNA species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23439 or 24759; and/or
  v) one RNA species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23534 or 24854;
wherein, preferably, each of the mRNA species comprise a Cap1 structure, and, optionally, each of the mRNA species do not comprise modified nucleotides.

In further preferred embodiments, the multivalent composition comprises at least two RNA species being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 149 or 24837, 23531 or 24851, 23530 or 24850, 23533 or 24853, 23439 or 24759 or 23534 or 24854.

In embodiments, the nucleic acid (e.g. DNA or RNA), preferably RNA species of the multivalent composition may be formulated separately (formulation as specified below). In preferred embodiments, the nucleic acid (e.g. DNA or RNA), preferably RNA species of the multivalent composition may be co-formulated separately (formulation as specified below).

Complexation:

In a preferred embodiment of the second aspect, the at least one nucleic acid (e.g. DNA or RNA), preferably the at least one RNA, is complexed or associated with further compound to obtain a formulated composition. A formulation in that context may have the function of a transfection agent. A formulation in that context may also have the function of protecting the nucleic acid from degradation.

In a preferred embodiment of the second aspect, the at least one nucleic acid (e.g. DNA or RNA), preferably the at least one RNA, and optionally the at least one further nucleic acid, is complexed or associated with, or at least partially complexed or partially associated with one or more cationic or polycationic compound, preferably cationic or polyca-tionic polymer, cationic or polycationic polysaccharide, cationic or polycationic lipid, cationic or polycationic protein, cationic or polycationic peptide, or any combinations thereof.

The term "cationic or polycationic compound" as used herein will be recognized and understood by the person of ordinary skill in the art, and are for example intended to refer to a charged molecule, which is positively charged at a pH value ranging from about 1 to 9, at a pH value ranging from about 3 to 8, at a pH value ranging from about 4 to 8, at a pH value ranging from about 5 to 8, more preferably at a pH value ranging from about 6 to 8, even more preferably at a pH value ranging from about 7 to 8, most preferably at a physiological pH, e.g. ranging from about 7.2 to about 7.5. Accordingly, a cationic component, e.g. a cationic peptide, cationic protein, cationic polymer, cationic polysaccharide, cationic lipid may be any positively charged compound or polymer which is positively charged under physiological conditions. A "cationic or polycationic peptide or protein" may contain at least one positively charged amino acid, or more than one positively charged amino acid, e.g. selected from Arg, His, Lys or Orn. Accordingly, "polycationic" components are also within the scope exhibiting more than one positive charge under the given conditions.

Cationic or polycationic compounds, being particularly preferred in this context may be selected from the following list of cationic or polycationic peptides or proteins of fragments thereof: protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides, pAntp, plsl, FGF, Lactoferrin, Transportan, Buforin-2, Bac715-24, SynB, SynB(1), pVEC, hCT-derived peptides, SAP, or histones. More preferably, the nucleic acid (e.g. DNA or RNA), e.g. the coding RNA, preferably the mRNA, is complexed with one or more polycations, preferably with protamine or oligofectamine, most preferably with protamine.

In preferred embodiment, the at least one nucleic acid (e.g. DNA or RNA), preferably the at least one RNA is complexed with protamine.

Further preferred cationic or polycationic compounds, which can be used as transfection or complexation agent may include cationic polysaccharides, for example chitosan, polybrene etc.; cationic lipids, e.g. DOTMA, DMRIE, di-C14-amidine, DOTIM, SAINT, DC-Chol, BGTC, CTAP, DOPC, DODAP, DOPE: Dioleyl phosphatidylethanolamine, DOSPA, DODAB, DOIC, DMEPC, DOGS, DIMRI, DOTAP, DC-6-14, CLIP1, CLIP6, CLIP9, oligofectamine; or cationic or polycationic polymers, e.g. modified polyaminoacids, such as beta-aminoacid-polymers or reversed polyamides, etc., modified polyethylenes, such as PVP etc., modified acrylates, such as pDMAEMA etc., modified amidoamines such as pAMAM etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI, poly(propyleneimine), etc., polyallylamine, sugar backbone based polymers, such as cyclodextrin based polymers, dextran based polymers, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

In this context it is particularly preferred that the at least one nucleic acid (e.g. DNA or RNA), preferably the at least one RNA is complexed or at least partially complexed with a cationic or polycationic compound and/or a polymeric carrier, preferably cationic proteins or peptides. In this context, the disclosure of WO2010/037539 and WO2012/113513 is incorporated herewith by reference. Partially means that only a part of the nucleic acid is complexed with a cationic compound and that the rest of the nucleic acid is in uncomplexed form ("free").

In embodiments, the composition comprises at least one nucleic acid (e.g. DNA or RNA), preferably at least one RNA, complexed with one or more cationic or polycationic compounds, preferably protamine, and at least one free (non-complexed) nucleic acid.

In this context it is particularly preferred that the at least one nucleic acid (e.g. DNA or RNA), preferably the at least one RNA is complexed, or at least partially complexed with protamine. Preferably, the molar ratio of the nucleic acid, particularly the RNA of the protamine-complexed RNA to the free RNA may be selected from a molar ratio of about 0.001:1 to about 1:0.001, including a ratio of about 1:1. Suitably, the complexed RNA is complexed with protamine by addition of protamine-trehalose solution to the RNA sample at a RNA:protamine weight to weight ratio (w/w) of 2:1.

Further preferred cationic or polycationic proteins or peptides that may be used for complexation can be derived from formula (Arg)l; (Lys)m; (His)n; (Orn)o; (Xaa)x of the patent application WO2009/030481 or WO2011/026641, the disclosure of WO2009/030481 or WO2011/026641 relating thereto incorporated herewith by reference.

In preferred embodiments, the at least one nucleic acid (e.g. DNA or RNA), preferably the at least one RNA is complexed, or at least partially complexed, with at least one cationic or polycationic proteins or peptides preferably selected from SEQ ID NOs: 269 to 273, or any combinations thereof.

According to various embodiments, the composition of the present invention comprises at least one nucleic acid (e.g. DNA or RNA), preferably at least one RNA as defined in the context of the first aspect, and a polymeric carrier.

The term "polymeric carrier" as used herein will be recognized and understood by the person of ordinary skill in the art, and are e.g. intended to refer to a compound that facilitates transport and/or complexation of another compound (e.g. cargo nucleic acid). A polymeric carrier is typically a carrier that is formed of a polymer. A polymeric carrier may be associated to its cargo (e.g. DNA, or RNA) by covalent or non-covalent interaction. A polymer may be based on different subunits, such as a copolymer.

Suitable polymeric carriers in that context may include, for example, polyacrylates, polyalkycyanoacrylates, polylactide, polylactide-polyglycolide copolymers, polycaprolactones, dextran, albumin, gelatin, alginate, collagen, chitosan, cyclodextrins, protamine, PEGylated protamine, PEGylated PLL and polyethylenimine (PEI), dithiobis(succinimidylpropionate) (DSP), Dimethyl-3,3'-dithiobispropionimidate (DTBP), poly(ethylene imine) biscarbamate (PEIC), poly(L-lysine) (PLL), histidine modified PLL, poly (N-vinylpyrrolidone) (PVP), poly(propylenimine) (PPI), poly(amidoamine) (PAMAM), poly(amido ethylenimine) (SS-PAEI), triehtylenetetramine (TETA), poly(pi-aminoester), poly(4-hydroxy-L-proine ester) (PHP), poly(allylamine), poly(a-[4-aminobutyl]-L-glycolic acid (PAGA), Poly(D,L-lactic-co-glycolid acid (PLGA), Poly(N-ethyl-4-vinylpyridinium bromide), poly(phosphazene)s (PPZ), poly (phosphoester)s (PPE), poly(phosphoramidate)s (PPA), poly (N-2-hydroxypropylmethacrylamide) (pHPMA), poly(2-(dimethylamino)ethyl methacrylate) (pDMAEMA), poly(2-aminoethyl propylene phosphate) PPE_EA), galactosylated chitosan, N-dodecylated chitosan, histone, collagen and dextran-spermine. In one embodiment, the polymer may be an inert polymer such as, but not limited to, PEG. In one embodiment, the polymer may be a cationic polymer such as, but not limited to, PEI, PLL, TETA, poly(allylamine), Poly(N-ethyl-4-vinylpyridinium bromide), pHPMA and pDMAEMA. In one embodiment, the polymer may be a biodegradable PEI such as, but not limited to, DSP, DTBP and PEIC. In one embodiment, the polymer may be biodegradable such as, but not limited to, histine modified PLL, SS-PAEI, poly(β-aminoester), PHP, PAGA, PLGA, PPZ, PPE, PPA and PPE-EA.

A suitable polymeric carrier may be a polymeric carrier formed by disulfide-crosslinked cationic compounds. The disulfide-crosslinked cationic compounds may be the same or different from each other. The polymeric carrier can also contain further components. The polymeric carrier used according to the present invention may comprise mixtures of cationic peptides, proteins or polymers and optionally further components as defined herein, which are crosslinked by disulfide bonds (via —SH groups).

In this context, polymeric carriers according to formula {(Arg)l; (Lys)m; (His)n; (Orn)o; (Xaa)x(Cys)y} and formula Cys, {(Arg)l; (Lys)m; (His)n; (Orn)o; (Xaa)x}Cys$_2$ of the patent application WO2012/013326 are preferred, the disclosure of WO2012/013326 relating thereto incorporated herewith by reference.

In embodiments, the polymeric carrier used to complex the at least one nucleic acid (e.g. DNA or RNA), preferably the at least one RNA may be derived from a polymeric carrier molecule according formula (L-P$^1$—S—[S—P$^2$—S]$_n$—S—P$^3$-L) of the patent application WO2011/026641, the disclosure of WO2011/026641 relating thereto incorporated herewith by reference.

In embodiments, the polymeric carrier compound is formed by, or comprises or consists of the peptide elements CysArg12Cys (SEQ ID NO: 269) or CysArg12 (SEQ ID NO: 270) or TrpArg12Cys (SEQ ID NO: 271). In particularly preferred embodiments, the polymeric carrier compound consists of a (R$_{12}$C)—(R$_{12}$C) dimer, a (WR$_{12}$C)—(WR$_{12}$C) dimer, or a (CR$_{12}$)—(CR$_{12}$)—(CR$_{12}$) trimer, wherein the individual peptide elements in the dimer (e.g. (WR12C)), or the trimer (e.g. (CR12)), are connected via —SH groups.

In a preferred embodiment of the second aspect, at least one nucleic acid (e.g. DNA or RNA), preferably the at least one RNA is complexed or associated with a polyethylene glycol/peptide polymer comprising HO-PEG5000-S—(S—CHHHHHHRRRRHHHHHC—S-)7-S-PEG5000-OH (SEQ ID NO: 272 as peptide monomer), HO-PEG5000-S—(S—CHHHHHHRRRRHHHHHC—S-)4-S-PEG5000-OH (SEQ ID NO: 272 as peptide monomer), HO-PEG5000-S—(S—CGHHHHHRRRRHHHHHGC—S-)7-S-PEG5000-OH (SEQ ID NO: 273 as peptide monomer) and/or a polyethylene glycol/peptide polymer comprising HO-PEG5000-S—(S—CGHHHHHRRRRHHHHHGC—S-)4-S-PEG5000-OH (SEQ ID NO: 273 of the peptide monomer).

In other embodiments, the composition comprises at least one nucleic acid (e.g. DNA or RNA), wherein the at least one nucleic acid, preferably the at least one RNA is complexed or associated with polymeric carriers and, optionally, with at least one lipid component as described in WO2017/212008A1, WO2017/212006A1, WO2017/212007A1, and WO2017/212009A1. In this context, the disclosures of WO2017/212008A1, WO2017/212006A1, WO2017/212007A1 and WO2017/212009A1 are herewith incorporated by reference.

In a particularly preferred embodiment, the polymeric carrier (of the first and/or second component) is a peptide polymer, preferably a polyethylene glycol/peptide polymer as defined above, and a lipid component, preferably a lipidoid component.

A lipidoid (or lipidoid) is a lipid-like compound, i.e. an amphiphilic compound with lipid-like physical properties. The lipidoid is preferably a compound, which comprises two or more cationic nitrogen atoms and at least two lipophilic tails. In contrast to many conventional cationic lipids, the lipidoid may be free of a hydrolysable linking group, in particular linking groups comprising hydrolysable ester, amide or carbamate groups. The cationic nitrogen atoms of the lipidoid may be cationisable or permanently cationic, or both types of cationic nitrogens may be present in the compound. In the context of the present invention, the term lipid is considered to also encompass lipidoids.

In some embodiments of the inventions, the lipidoid may comprise a PEG moiety.

In preferred embodiments, the at least one nucleic acid (e.g. DNA or RNA), preferably the at least one RNA is complexed or associated with a polymeric carrier, preferably with a polyethylene glycol/peptide polymer as defined above, and a lipidoid component.

Suitably, the lipidoid is cationic, which means that it is cationisable or permanently cationic. In one embodiment, the lipidoid is cationisable, i.e. it comprises one or more cationisable nitrogen atoms, but no permanently cationic nitrogen atoms. In another embodiment, at least one of the cationic nitrogen atoms of the lipidoid is permanently cationic.

Optionally, the lipidoid comprises two permanently cationic nitrogen atoms, three permanently cationic nitrogen atoms, or even four or more permanently cationic nitrogen atoms.

In a preferred embodiment, the lipidoid component may be any one selected from the lipidoids of the lipidoids provided in the table of page 50-54 of published PCT patent application WO2017/212009A1, the specific lipidoids provided in said table, and the specific disclosure relating thereto herewith incorporated by reference.

In preferred embodiments, the lipidoid component may be any one selected from 3-C12-OH, 3-C12-OH-cat, 3-C12-amide, 3-C12-amide monomethyl, 3-C12-amide dimethyl, RevPEG(10)-3-C12-OH, RevPEG(10)-DLin-pAbenzoic, 3C12amide-TMA cat., 3C12amide-DMA, 3C12amide-NH2, 3C12amide-OH, 3C12Ester-OH, 3C12 Ester-amin, 3C12Ester-DMA, 2C12Amid-DMA, 3C12-lin-amid-DMA, 2C12-sperm-amid-DMA, or 3C12-sperm-amid-DMA (see table of published PCT patent application WO2017/212009A1 (pages 50-54)). Particularly preferred are 3-C12-OH or 3-C12-OH-cat.

In preferred embodiments, the polyethylene glycol/peptide polymer comprising a lipidoid as specified above (e.g. 3-C12-OH or 3-C12-OH-cat), is used to complex the at least one nucleic acid to form complexes having an N/P ratio from about 0.1 to about 20, or from about 0.2 to about 15, or from about 2 to about 15, or from about 2 to about 12, wherein the N/P ratio is defined as the mole ratio of the nitrogen atoms of the basic groups of the cationic peptide or polymer to the phosphate groups of the nucleic acid. In that context, the disclosure of published PCT patent application WO2017/212009A1, in particular claims 1 to 10 of WO2017/212009A1, and the specific disclosure relating thereto is herewith incorporated by reference.

Further suitable lipidoids may be derived from published PCT patent application WO2010/053572. In particular, lipidoids derivable from claims 1 to 297 of published PCT patent application WO2010/053572 may be used in the context of the invention, e.g. incorporated into the peptide polymer as described herein, or e.g. incorporated into the lipid nanoparticle (as described below). Accordingly, claims 1 to 297 of published PCT patent application WO2010/053572, and the specific disclosure relating thereto, is herewith incorporated by reference.

Encapsulation/Complexation in LNPs:

In preferred embodiments of the second aspect, the at least one nucleic acid (e.g. DNA or RNA), preferably the at least one RNA, and optionally the at least one further nucleic acid, is complexed, encapsulated, partially encapsulated, or associated with one or more lipids (e.g. cationic lipids and/or neutral lipids), thereby forming lipid-based carriers such as liposomes, lipid nanoparticles (LNPs), lipoplexes, and/or nanoliposomes.

The liposomes, lipid nanoparticles (LNPs), lipoplexes, and/or nanoliposomes-incorporated nucleic acid (e.g. DNA or RNA) may be completely or partially located in the interior space of the liposomes, lipid nanoparticles (LNPs), lipoplexes, and/or nanoliposomes, within the lipid layer/membrane, or associated with the exterior surface of the lipid layer/membrane. The incorporation of a nucleic acid into liposomes/LNPs is also referred to herein as "encapsulation" wherein the nucleic acid, e.g. the RNA is entirely contained within the interior space of the liposomes, lipid nanoparticles (LNPs), lipoplexes, and/or nanoliposomes. The purpose of incorporating nucleic acid into liposomes, lipid nanoparticles (LNPs), lipoplexes, and/or nanoliposomes is to protect the nucleic acid, preferably RNA from an environment which may contain enzymes or chemicals or conditions that degrade nucleic acid and/or systems or receptors that cause the rapid excretion of the nucleic acid. Moreover, incorporating nucleic acid, preferably RNA into liposomes, lipid nanoparticles (LNPs), lipoplexes, and/or nanoliposomes may promote the uptake of the nucleic acid, and hence, may enhance the therapeutic effect of the nucleic acid, e.g. the RNA encoding antigenic SARS-CoV-2 (nCoV-2019) proteins. Accordingly, incorporating a nucleic acid, e.g. RNA or DNA, into liposomes, lipid nanoparticles (LNPs), lipoplexes, and/or nanoliposomes may be particularly suitable for a coronavirus vaccine (e.g. a SARS-CoV-2 vaccine), e.g. for intramuscular and/or intradermal administration.

In this context, the terms "complexed" or "associated" refer to the essentially stable combination of nucleic acid with one or more lipids into larger complexes or assemblies without covalent binding.

The term "lipid nanoparticle", also referred to as "LNP", is not restricted to any particular morphology, and include any morphology generated when a cationic lipid and optionally one or more further lipids are combined, e.g. in an aqueous environment and/or in the presence of a nucleic acid, e.g. an RNA. For example, a liposome, a lipid complex, a lipoplex and the like are within the scope of a lipid nanoparticle (LNP).

Liposomes, lipid nanoparticles (LNPs), lipoplexes, and/or nanoliposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 nm and 500 nm in diameter.

LNPs of the invention are suitably characterized as microscopic vesicles having an interior aqua space sequestered from an outer medium by a membrane of one or more bilayers. Bilayer membranes of LNPs are typically formed by amphiphilic molecules, such as lipids of synthetic or natural origin that comprise spatially separated hydrophilic and hydrophobic domains. Bilayer membranes of the liposomes can also be formed by amphiphilic polymers and surfactants (e.g., polymerosomes, niosomes, etc.). In the context of the present invention, an LNP typically serves to transport the at least one nucleic acid, preferably the at least one RNA to a target tissue.

Accordingly, in preferred embodiments of the second aspect, the at least one nucleic acid, preferably the at least one RNA is complexed with one or more lipids thereby forming lipid nanoparticles (LNP). Preferably, said LNP is particularly suitable for intramuscular and/or intradermal administration. LNPs typically comprise a cationic lipid and one or more excipients selected from neutral lipids, charged lipids, steroids and polymer conjugated lipids (e.g. PEGylated lipid). The nucleic acid (e.g. RNA, DNA) may be encapsulated in the lipid portion of the LNP or an aqueous space enveloped by some or the entire lipid portion of the LNP. The nucleic acid (e.g. RNA, DNA) or a portion thereof may also be associated and complexed with the LNP. An LNP may comprise any lipid capable of forming a particle to which the nucleic acids are attached, or in which the one or more nucleic acids are encapsulated. Preferably, the LNP comprising nucleic acids comprises one or more cationic lipids, and one or more stabilizing lipids. Stabilizing lipids include neutral lipids and PEGylated lipids.

Preferably, the LNP comprises
(i) at least one cationic lipid;
(ii) at least one neutral lipid;
(iii) at least one steroid or steroid analogue, preferably cholesterol; and
(iv) at least one polymer conjugated lipid, preferably a PEG-lipid;
wherein (i) to (iv) are in a molar ratio of about 20-60% cationic lipid, 5-25% neutral lipid, 25-55% sterol, and 0.5-15% polymer conjugated lipid.

The cationic lipid of an LNP may be cationisable, i.e. it becomes protonated as the pH is lowered below the pK of the ionizable group of the lipid, but is progressively more neutral at higher pH values. At pH values below the pK, the lipid is then able to associate with negatively charged nucleic acids. In certain embodiments, the cationic lipid comprises a zwitterionic lipid that assumes a positive charge on pH decrease.

Such lipids include, but are not limited to, DSDMA, N,N-dioleyl-N,N-dimethylammonium chloride (DODAC), N,N-distearyl-N,N-dimethylammonium bromide (DDAB), 1,2-dioleoyltrimethyl ammonium propane chloride (DOTAP) (also known as N-(2,3-dioleoyloxy)propyl)-N,N,N-trimethylammonium chloride and 1,2-Dioleyloxy-3-trimethylaminopropane chloride salt), N-(1-(2,3-dioleyloxy)propyl)-N,N,N-trimethylammonium chloride (DOTMA), N,N-dimethyl-2,3-dioleyloxy)propylamine (DODMA), ckk-E12, ckk, 1,2-DiLinoleyloxy-N,N-dimethylaminopropane (DLinDMA), 1,2-Dilinolenyloxy-N,N-dimethylaminopropane (DLenDMA), 1,2-di-γ-linolenyloxy-N,N-dimethylaminopropane (γ-DLenDMA), 98N12-5, 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), ICE (Imidazol-based), HGT5000, HGT5001, DMDMA, CLinDMA, CpLinDMA, DMOBA, DOcarbDAP, DLincarbDAP, DLinCDAP, KLin-K-DMA, DLin-K-XTC2-DMA, XTC (2,2-Dilinoleyl-4-dimethylaminoethyl-[1,3]-dioxolane) HGT4003, 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl) tetrahydro-3aH-cyclopenta[d][1,3]dioxol-5-amine, (6Z,9Z, 28Z,31Z)-heptatriaconta-6,9,28,31-tetraen-19-yl-4-(dimethylamino)butanoate (MC3), ALNY-100 ((3aR,5s, 6aS)-N,N-dimethyl-2,2-di((9Z,12Z)-octadeca-9,12-dienyl) tetrahydro-3aH-cyclopenta[d] [1,3]dioxol-5-amine)), 1,1'-(2-(4-(2-((2-(bis(2-hydroxydodecyl)amino)ethyl)(2-hydroxydodecyl)amino)ethyl)piperazin-1-yl) ethylazanediyl)didodecan-2-ol (C12-200), 2,2-dilinoleyl-4-(2-dimethylaminoethyl)-[1,3]-dioxolane (DLin-K-C2-DMA), 2,2-dilinoleyl-4-dimethylaminomethyl-[1,3]-dioxolane (DLin-K-DMA), NC98-5 (4,7,13-tris(3-oxo-3-(undecylamino)propyl)-N1,N16-diundecyl-4,7,10,13-tetraazahexadecane-1, 16-diamide), (6Z,9Z,28Z,31Z)-heptatriaconta-6,9,28,31-tetraen-19-yl 4-(dimethylamino) butanoate (DLin-M-C3-DMA), 3-((6Z,9Z,28Z,31Z)-heptatriaconta-6,9,28,31-tetraen-19-yloxy)-N,N-dimethylpropan-1-amine (MC3 Ether), 4-((6Z,9Z,28Z,31Z)-heptatriaconta-6,9,28,31-tetraen-19-yloxy)-N,N-dimethylbutan-1-amine (MC4 Ether), LIPOFECTIN® (commercially available cationic liposomes comprising DOTMA and 1,2-dioleoyl-sn-3phosphoethanolamine (DOPE), from GIBCO/BRL, Grand Island, N.Y.); LIPOFECTAMINE® (commercially available cationic liposomes comprising N-(1-(2,3dioleyloxy)propyl)-N-(2-(sperminecarboxamido)ethyl)-N,N-dimethylammonium trifluoroacetate (DOSPA) and (DOPE), from GIBCO/BRL); and TRANSFECTAM® (commercially available cationic lipids comprising dioctadecylamidoglycyl carboxyspermine (DOGS) in ethanol from Promega Corp., Madison, Wis.) or any combination of any of the foregoing. Further suitable cationic lipids for use in the compositions and methods of the invention include those described in international patent publications WO2010/053572 (and particularly, CI 2-200 described at paragraph [00225]) and WO2012/170930, both of which are incorporated herein by reference, HGT4003, HGT5000, HGTS001, HGT5001, HGT5002 (see US20150140070A1).

In embodiments, the cationic lipid may be an amino lipid.
Representative amino lipids include, but are not limited to, 1,2-dilinoleyoxy-3-(dimethylamino)acetoxypropane (DLin-DAC), 1,2-dilinoleyoxy-3morpholinopropane (DLin-MA), 1,2-dilinoleoyl-3-dimethylaminopropane (DLinDAP), 1,2-dilinoleylthio-3-dimethylaminopropane (DLin-S-DMA), 1-linoleoyl-2-linoleyloxy-3dimethylaminopropane (DLin-2-DMAP), 1,2-dilinoleyloxy-3-trimethylaminopropane chloride salt (DLin-TMA.Cl), 1,2-dilinoleoyl-3-trimethylaminopropane chloride salt (DLin-TAP.Cl), 1,2-dilinoleyloxy-3-(N-methylpiperazino)propane (DLin-MPZ), 3-(N,Ndilinoleylamino)-1,2-propanediol (DLinAP), 3-(N,N-dioleylamino)-1,2-propanediol (DOAP), 1,2-dilinoleyloxo-3-(2-N,N-dimethylamino)ethoxypropane (DLin-EG-DMA), and 2,2-dilinoleyl-4-dimethylaminomethyl-[1,3]-dioxolane (DLin-K-DMA), 2,2-dilinoleyl-4-(2-dimethylaminoethyl)-[1,3]-dioxolane (DLin-KC2-DMA); dilinoleyl-methyl-4-dimethylaminobutyrate (DLin-MC3-DMA); MC3 (US20100324120).

In embodiments, the cationic lipid may an aminoalcohol lipidoid.

Aminoalcohol lipidoids which may be used in the present invention may be prepared by the methods described in U.S. Pat. No. 8,450,298, herein incorporated by reference in its entirety. Suitable (ionizable) lipids can also be the compounds as disclosed in Tables 1, 2 and 3 and as defined in claims 1-24 of WO2017/075531A1, hereby incorporated by reference.

In another embodiment, suitable lipids can also be the compounds as disclosed in WO2015/074085A1 (i.e. ATX-001 to ATX-032 or the compounds as specified in claims 1-26), U.S. Appl. No. 61/905,724 and Ser. No. 15/614,499 or U.S. Pat. Nos. 9,593,077 and 9,567,296 hereby incorporated by reference in their entirety.

In other embodiments, suitable cationic lipids can also be the compounds as disclosed in WO2017/117530A1 (i.e. lipids 13, 14, 15, 16, 17, 18, 19, 20, or the compounds as specified in the claims), hereby incorporated by reference in its entirety.

In preferred embodiments, ionizable or cationic lipids may also be selected from the lipids disclosed in WO2018/078053A1 (i.e. lipids derived from formula I, II, and III of WO2018/078053A1, or lipids as specified in Claims 1 to 12 of WO2018/078053A1), the disclosure of WO2018/078053A1 hereby incorporated by reference in its entirety. In that context, lipids disclosed in Table 7 of WO2018/078053A1 (e.g. lipids derived from formula I-1 to 1-41) and lipids disclosed in Table 8 of WO2018/078053A1 (e.g. lipids derived from formula II-1 to 11-36) may be suitably used in the context of the invention. Accordingly, formula I-1 to formula I-41 and formula II-1 to formula II-36 of WO2018/078053A1, and the specific disclosure relating thereto, are herewith incorporated by reference.

In preferred embodiments, cationic lipids may be derived from formula III of published PCT patent application WO2018/078053A1. Accordingly, formula III of WO2018/078053A1, and the specific disclosure relating thereto, are herewith incorporated by reference.

In particularly preferred embodiments, the at least one nucleic acid (e.g. DNA or RNA), preferably the at least one RNA of the composition is complexed with one or more lipids thereby forming LNPs, wherein the cationic lipid of the LNP is selected from structures III-I to III-36 of Table 9 of published PCT patent application WO2018/078053A1. Accordingly, formula III-1 to III-36 of WO2018/078053A1, and the specific disclosure relating thereto, are herewith incorporated by reference.

In particularly preferred embodiment of the second aspect, the at least one nucleic acid (e.g. DNA or RNA), preferably the at least one RNA is complexed with one or more lipids thereby forming LNPs, wherein the LNPs comprises a cationic lipid according to formula III-3:

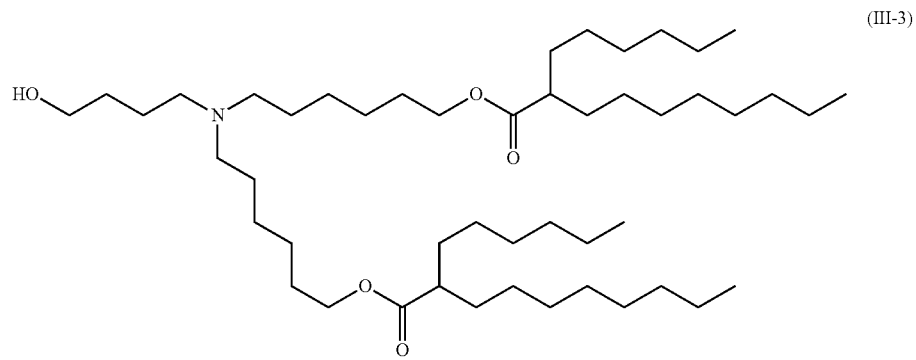 [SMILES: CCCCCCCCC(CCCCCC)C(=O)OCCCCCCN(CCCCO)CCCCCCOC(=O)C(CCCCCC)CCCCCCCC]

(III-3)

The lipid of formula III-3 as suitably used herein has the chemical term ((4-hydroxybutyl)azanediyl)bis(hexane-6,1-diyl)bis(2-hexyldecanoate), also referred to as ALC-0315.

In certain embodiments, the cationic lipid as defined herein, more preferably cationic lipid compound III-3, is present in the LNP in an amount from about 30 to about 95 mole percent, relative to the total lipid content of the LNP. If more than one cationic lipid is incorporated within the LNP, such percentages apply to the combined cationic lipids.

In embodiments, the cationic lipid is present in the LNP in an amount from about 30 to about 70 mole percent. In one embodiment, the cationic lipid is present in the LNP in an amount from about 40 to about 60 mole percent, such as about 40, 41, 42, 43, 44, 45, 46, 47, 48, 49, 50, 51, 52, 53, 54, 55, 56, 57, 58, 59 or 60 mole percent, respectively. In embodiments, the cationic lipid is present in the LNP in an amount from about 47 to about 48 mole percent, such as about 47.0, 47.1, 47.2, 47.3, 47.4, 47.5, 47.6, 47.7, 47.8, 47.9, 50.0 mole percent, respectively, wherein 47.7 mole percent are particularly preferred.

In some embodiments, the cationic lipid is present in a ratio of from about 20 mol % to about 70 or 75 mol % or from about 45 to about 65 mol % or about 20, 25, 30, 35, 40, 45, 50, 55, 60, 65, or about 70 mol % of the total lipid present in the LNP. In further embodiments, the LNPs comprise from about 25% to about 75% on a molar basis of cationic lipid, e.g., from about 20 to about 70%, from about 35 to about 65%, from about 45 to about 65%, about 60%, about 57.5%, about 57.1%, about 50% or about 40% on a molar basis (based upon 100% total moles of lipid in the lipid nanoparticle). In some embodiments, the ratio of cationic lipid to nucleic acid (e.g. coding RNA or DNA) is from about 3 to about 15, such as from about 5 to about 13 or from about 7 to about 11.

Other suitable (cationic or ionizable) lipids are disclosed in WO2009/086558, WO2009/127060, WO2010/048536, WO2010/054406, WO2010/088537, WO2010/129709, WO2011/153493, WO 2013/063468, US2011/0256175, US2012/0128760, US2012/0027803, U.S. Pat. No. 8,158,601, WO2016/118724, WO2016/118725, WO2017/070613, WO2017/070620, WO2017/099823, WO2012/040184, WO2011/153120, WO2011/149733, WO2011/090965, WO2011/043913, WO2011/022460, WO2012/061259, WO2012/054365, WO2012/044638, WO2010/080724, WO2010/21865, WO2008/103276, WO2013/086373, WO2013/086354, U.S. Pat. Nos. 7,893,302, 7,404,969, 8,283,333, 8,466,122 and 8,569,256 and US Patent Publication No. US2010/0036115, US2012/0202871, US2013/0064894, US2013/0129785, US2013/0150625, US2013/0178541, US2013/0225836, US2014/0039032 and WO2017/112865. In that context, the disclosures of WO2009/086558, WO2009/127060, WO2010/048536, WO2010/054406, WO2010/088537, WO2010/129709, WO2011/153493, WO 2013/063468, US2011/0256175, US2012/0128760, US2012/0027803, U.S. Pat. No. 8,158,601, WO2016/118724, WO2016/118725, WO2017/070613, WO2017/070620, WO2017/099823, WO2012/040184, WO2011/153120, WO2011/149733, WO2011/090965, WO2011/043913, WO2011/022460, WO2012/061259, WO2012/054365, WO2012/044638, WO2010/080724, WO2010/21865, WO2008/103276, WO2013/086373, WO2013/086354, U.S. Pat. Nos. 7,893,302, 7,404,969, 8,283,333, 8,466,122 and 8,569,256 and US Patent Publication No. US2010/0036115, US2012/0202871, US2013/0064894, US2013/0129785, US2013/0150625, US2013/0178541, US2013/0225836 and US2014/0039032 and WO2017/112865 specifically relating to (cationic) lipids suitable for LNPs are incorporated herewith by reference.

In embodiments, amino or cationic lipids as defined herein have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of lipids have to be present in the charged or neutral form. Lipids having more than one protonatable or deprotonatable group, or which are zwitterionic, are not excluded and may likewise suitable in the context of the present invention. In some embodiments, the protonatable lipids have a pKa of the protonatable group in the range of about 4 to about 11, e.g., a pKa of about 5 to about 7.

LNPs can comprise two or more (different) cationic lipids as defined herein. Cationic lipids may be selected to contribute to different advantageous properties. For example, cationic lipids that differ in properties such as amine pKa, chemical stability, half-life in circulation, half-life in tissue, net accumulation in tissue, or toxicity can be used in the LNP. In particular, the cationic lipids can be chosen so that the properties of the mixed-LNP are more desirable than the properties of a single-LNP of individual lipids.

The amount of the permanently cationic lipid or lipidoid may be selected taking the amount of the nucleic acid cargo into account. In one embodiment, these amounts are selected such as to result in an N/P ratio of the nanoparticle(s) or of the composition in the range from about 0.1 to about 20. In this context, the N/P ratio is defined as the mole ratio of the nitrogen atoms ("N") of the basic nitrogen-containing groups of the lipid or lipidoid to the phosphate groups ("P") of the nucleic acid which is used as cargo. The N/P ratio may be calculated on the basis that, for example, 1 ug RNA typically contains about 3 nmol phosphate residues, provided that the RNA exhibits a statistical distribution of bases. The "N"-value of the lipid or lipidoid may be calculated on the basis of its molecular weight and the relative content of permanently cationic and—if present—cationisable groups.

In vivo characteristics and behavior of LNPs can be modified by addition of a hydrophilic polymer coating, e.g. polyethylene glycol (PEG), to the LNP surface to confer steric stabilization. Furthermore, LNPs can be used for specific targeting by attaching ligands (e.g. antibodies, peptides, and carbohydrates) to its surface or to the terminal end of the attached PEG chains (e.g. via PEGylated lipids or PEGylated cholesterol).

In some embodiments, the LNPs comprise a polymer conjugated lipid. The term "polymer conjugated lipid" refers to a molecule comprising both a lipid portion and a polymer portion. An example of a polymer conjugated lipid is a PEGylated lipid. The term "PEGylated lipid" refers to a molecule comprising both a lipid portion and a polyethylene glycol portion. PEGylated lipids are known in the art and include 1-(monomethoxy-polyethyleneglycol)-2,3-dimyristoylglycerol (PEG-s-DMG) and the like.

A polymer conjugated lipid as defined herein, e.g. a PEG-lipid, may serve as an aggregation reducing lipid.

In certain embodiments, the LNP comprises a stabilizing-lipid which is a polyethylene glycol-lipid (PEGylated lipid). Suitable polyethylene glycol-lipids include PEG-modified phosphatidylethanolamine, PEG-modified phosphatidic acid, PEG-modified ceramides (e.g. PEG-CerC14 or PEG-CerC20), PEG-modified dialkylamines, PEG-modified diacylglycerols, PEG-modified dialkylglycerols. Representative polyethylene glycol-lipids include PEG-c-DOMG, PEG-c-DMA, and PEG-s-DMG. In one embodiment, the polyethylene glycol-lipid is N-[(methoxy poly(ethylene glycol)2000)carbamyl]-1,2-dimyristyloxlpropyl-3-amine (PEG-c-DMA). In a preferred embodiment, the polyethylene glycol-lipid is PEG-2000-DMG. In one embodiment, the polyethylene glycol-lipid is PEG-c-DOMG). In other embodiments, the LNPs comprise a PEGylated diacylglycerol (PEG-DAG) such as 1-(monomethoxy-polyethyleneglycol)-2,3-dimyristoylglycerol (PEG-DMG), a PEGylated phosphatidyletholoamine (PEG-PE), a PEG succinate diacylglycerol (PEG-S-DAG) such as 4-O-(2',3'-di(tetradecanoyloxy)propyl-1-O-(ω-methoxy(polyethoxy) ethyl)butanedioate (PEG-S-DMG), a PEGylated ceramide (PEG-cer), or a PEG dialkoxypropylcarbamate such as ω-methoxy(polyethoxy)ethyl-N-(2,3di(tetradecanoxy)propyl)carbamate or 2,3-di(tetradecanoxy)propyl-N-(ω-methoxy(polyethoxy)ethyl)carbamate.

In preferred embodiments, the PEGylated lipid is preferably derived from formula (IV) of published PCT patent application WO2018/078053A1. Accordingly, PEGylated lipids derived from formula (IV) of published PCT patent application WO2018/078053A1, and the respective disclosure relating thereto, are herewith incorporated by reference.

In a particularly preferred embodiments, the at least one nucleic acid (e.g. RNA or DNA) of the composition is complexed with one or more lipids thereby forming LNPs, wherein the LNP comprises a PEGylated lipid, wherein the PEG lipid is preferably derived from formula (IVa) of published PCT patent application WO2018/078053A1.

Accordingly, PEGylated lipid derived from formula (IVa) of published PCT patent application WO2018/078053A1, and the respective disclosure relating thereto, is herewith incorporated by reference.

In a particularly preferred embodiment, the at least one nucleic acid, preferably the at least one RNA is complexed with one or more lipids thereby forming lipid nanoparticles (LNP), wherein the LNP comprises a PEGylated lipid/PEG lipid. Preferably, said PEG lipid is of formula (IVa):

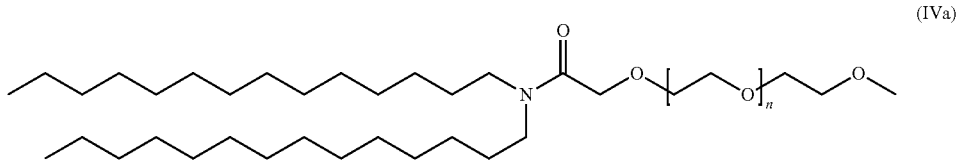

(IVa)

wherein n has a mean value ranging from 30 to 60, such as about 30±2, 32±2, 34±2, 36±2, 38±2, 40±2, 42±2, 44±2, 46±2, 48±2, 50±2, 52±2, 54±2, 56±2, 58±2, or 60±2. In a most preferred embodiment n is about 49. In further preferred aspects said PEG lipid is of formula (IVa) wherein n is an integer selected such that the average molecular weight of the PEG lipid is about 2000 g/mol to about 3000 g/mol or about 2300 g/mol to about 2700 g/mol, even more preferably about 2500 g/mol.

The lipid of formula IVa as suitably used herein has the chemical term 2[(polyethylene glycol)-2000]-N,N-ditetradecylacetamide, also referred to as ALC-0159.

Further examples of PEG-lipids suitable in that context are provided in US2015/0376115A1 and WO2015/199952, each of which is incorporated by reference in its entirety.

In some embodiments, LNPs include less than about 3, 2, or 1 mole percent of PEG or PEG-modified lipid, based on the total moles of lipid in the LNP. In further embodiments, LNPs comprise from about 0.1% to about 20% of the PEG-modified lipid on a molar basis, e.g., about 0.5 to about 10%, about 0.5 to about 5%, about 10%, about 5%, about 3.5%, about 3%, about 2,5%, about 2%, about 1.5%, about 1%, about 0.5%, or about 0.3% on a molar basis (based on 100% total moles of lipids in the LNP). In preferred embodiments, LNPs comprise from about 1.0% to about 2.0% of the PEG-modified lipid on a molar basis, e.g., about 1.2 to about 1.9%, about 1.2 to about 1.8%, about 1.3 to about 1.8%, about 1.4 to about 1.8%, about 1.5 to about 1.8%, about 1.6 to about 1.8%, in particular about 1.4%, about 1.5%, about 1.6%, about 1.7%, about 1.8%, about 1.9%, most preferably 1.7% (based on 100% total moles of lipids in the LNP). In various embodiments, the molar ratio of the cationic lipid to the PEGylated lipid ranges from about 100:1 to about 25:1.

In preferred embodiments, the LNP comprises one or more additional lipids, which stabilize the formation of particles during their formation or during the manufacturing process (e.g. neutral lipid and/or one or more steroid or steroid analogue).

In preferred embodiments of the second aspect, the at least one nucleic acid, preferably the at least one RNA is complexed with one or more lipids thereby forming lipid nanoparticles (LNP), wherein the LNP comprises one or more neutral lipid and/or one or more steroid or steroid analogue.

Suitable stabilizing lipids include neutral lipids and anionic lipids. The term "neutral lipid" refers to any one of a number of lipid species that exist in either an uncharged or neutral zwitterionic form at physiological pH. Representative neutral lipids include diacylphosphatidylcholines, diacylphosphatidylethanolamines, ceramides, sphingomyelins, dihydro sphingomyelins, cephalins, and cerebrosides.

In embodiments of the second aspect, the LNP comprises one or more neutral lipids, wherein the neutral lipid is selected from the group comprising distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE) and dioleoyl-phosphatidylethanolamine 4-(N-maleimidomethyl)-cyclohexane-1carboxylate (DOPE-mal), dipalmitoyl phosphatidyl ethanolamine (DPPE), dimyristoylphosphoethanolamine (DMPE), distearoyl-phosphatidylethanolamine (DSPE), 16-O-monomethyl PE, 16-O-dimethyl PE, 18-1-trans PE, 1-stearioyl-2-oleoylphosphatidyethanol amine (SOPE), and 1,2-dielaidoyl-sn-glycero-3-phophoethanolamine (transDOPE), or mixtures thereof.

In some embodiments, the LNPs comprise a neutral lipid selected from DSPC, DPPC, DMPC, DOPC, POPC, DOPE and SM. In various embodiments, the molar ratio of the cationic lipid to the neutral lipid ranges from about 2:1 to about 8:1.

In preferred embodiments, the neutral lipid is 1,2-distearoyl-sn-glycero-3-phosphocholine (DSPC). The molar ratio of the cationic lipid to DSPC may be in the range from about 2:1 to about 8:1.

In preferred embodiments, the steroid is cholesterol. The molar ratio of the cationic lipid to cholesterol may be in the range from about 2:1 to about 1:1. In some embodiments, the cholesterol may be PEGylated.

The sterol can be about 10 mol % to about 60 mol % or about 25 mol % to about 40 mol % of the lipid particle. In one embodiment, the sterol is about 10, 15, 20, 25, 30, 35, 40, 45, 50, 55, or about 60 mol % of the total lipid present in the lipid particle. In another embodiment, the LNPs include from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the lipid nanoparticle).

Preferably, lipid nanoparticles (LNPs) comprise: (a) the at least one nucleic acid, preferably the at least one RNA of the first aspect, (b) a cationic lipid, (c) an aggregation reducing agent (such as polyethylene glycol (PEG) lipid or PEG-modified lipid), (d) optionally a non-cationic lipid (such as a neutral lipid), and (e) optionally, a sterol.

In some embodiments, the cationic lipids (as defined above), non-cationic lipids (as defined above), cholesterol (as defined above), and/or PEG-modified lipids (as defined above) may be combined at various relative molar ratios. For example, the ratio of cationic lipid to non-cationic lipid to cholesterol-based lipid to PEGylated lipid may be between about 30-60:20-35:20-30:1-15, or at a ratio of about 40:30:25:5, 50:25:20:5, 50:27:20:3, 40:30:20:10, 40:32:20:8, 40:32:25:3 or 40:33:25:2, or at a ratio of about 50:25:20:5, 50:20:25:5, 50:27:20:3 40:30:20:10, 40:30:25:5 or 40:32:20:8, 40:32:25:3 or 40:33:25:2, respectively.

In some embodiments, the LNPs comprise a lipid of formula (III), the at least one nucleic acid, preferably the at least one RNA as defined herein, a neutral lipid, a steroid and a PEGylated lipid. In preferred embodiments, the lipid of formula (III) is lipid compound III-3 (ALC-0315), the neutral lipid is DSPC, the steroid is cholesterol, and the PEGylated lipid is the compound of formula (IVa) (ALC-0159).

In a preferred embodiment of the second aspect, the LNP consists essentially of (i) at least one cationic lipid; (ii) a neutral lipid; (iii) a sterol, e.g., cholesterol; and (iv) a PEG-lipid, e.g. PEG-DMG or PEG-cDMA, in a molar ratio of about 20-60% cationic lipid: 5-25% neutral lipid: 25-55% sterol; 0.5-15% PEG-lipid.

In particularly preferred embodiments, the at least one nucleic acid, preferably the at least one RNA is complexed with one or more lipids thereby forming lipid nanoparticles (LNP), wherein the LNP comprises
(i) at least one cationic lipid as defined herein, preferably a lipid of formula (III), more preferably lipid III-3 (ALC-0315);
(ii) at least one neutral lipid as defined herein, preferably 1,2-distearoyl-sn-glycero-3-phosphocholine (DSPC);
(iii) at least one steroid or steroid analogue as defined herein, preferably cholesterol; and
(iv) at least one PEG-lipid as defined herein, e.g. PEG-DMG or PEG-cDMA, preferably a PEGylated lipid that is or is derived from formula (IVa) (ALC-0159).

In particularly preferred embodiments, the at least one nucleic acid, preferably the at least one RNA is complexed with one or more lipids thereby forming lipid nanoparticles (LNP), wherein the LNP comprises (i) to (iv) in a molar ratio of about 20-60% cationic lipid: 5-25% neutral lipid: 25-55% sterol; 0.5-15% PEG-lipid.

In one preferred embodiment, the lipid nanoparticle comprises: a cationic lipid with formula (III) and/or PEG lipid with formula (IV), optionally a neutral lipid, preferably 1,2-distearoyl-sn-glycero-3-phosphocholine (DSPC) and optionally a steroid, preferably cholesterol, wherein the molar ratio of the cationic lipid to DSPC is optionally in the range from about 2:1 to 8:1, wherein the molar ratio of the cationic lipid to cholesterol is optionally in the range from about 2:1 to 1:1.

In a particular preferred embodiment, the composition of the second aspect comprising the at least one nucleic acid, preferably the at least one RNA, comprises lipid nanoparticles (LNPs), which have a molar ratio of approximately 50:10:38.5:1.5, preferably 47.5:10:40.8:1.7 or more preferably 47.4:10:40.9:1.7 (i.e. proportion (mol %) of cationic lipid (preferably lipid III-3 (ALC-0315)), DSPC, cholesterol and PEG-lipid (preferably PEG-lipid of formula (IVa) with n=49, even more preferably PEG-lipid of formula (IVa) with n=45 (ALC-0159)); solubilized in ethanol).

Most preferably, the composition of the second aspect comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 163 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). In this preferred embodiment the nucleic acid, preferably mRNA is not chemically modified.

In another most preferred embodiment, the composition of the second aspect comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 149 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). In this preferred embodiment the nucleic acid, preferably mRNA is not chemically modified.

In another most preferred embodiment, the composition of the second aspect comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 24837 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45) (ALC-0159). In this preferred embodiment the nucleic acid, preferably mRNA is not chemically modified.

In a further preferred embodiment, the composition of the second aspect comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 23311, 23531, or 24851 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45) (ALC-0159). In this preferred embodiment the nucleic acid, preferably mRNA is not chemically modified.

In a further preferred embodiment, the composition of the second aspect comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 23310, 23530, 23313, or 23533 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45) (ALC-0159). In this preferred embodiment the nucleic acid, preferably mRNA is not chemically modified.

In embodiments where the composition is a multivalent composition as defined above, the nucleic acid species (e.g. DNA or RNA), preferably RNA species of the multivalent composition may be formulated separately, preferably formulated separately in liposomes or LNPs. Suitably, the RNA species of the multivalent composition are separately formulated in LNPs which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45). Nucleic acid species for multivalent compositions are preferably selected as defined above (see section "Multivalent compositions of the invention")

In embodiments where the composition is a multivalent composition as defined above, the nucleic acid species (e.g. DNA or RNA), preferably RNA species of the multivalent composition may be co-formulated, preferably co-formulated in liposomes or LNPs. Suitably, the RNA species of the multivalent composition are co-formulated in LNPs which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45).

Nucleic acid species for multivalent compositions are preferably selected as defined above (see section "Multivalent compositions of the invention").

The total amount of nucleic acid in the lipid nanoparticles may vary and is defined depending on the e.g. nucleic acid to total lipid w/w ratio. In one embodiment of the invention the nucleic acid, in particular the RNA to total lipid ratio is less than 0.06 w/w, preferably between 0.03 w/w and 0.04 w/w.

In some embodiments, the lipid nanoparticles (LNPs), which are composed of only three lipid components, namely imidazole cholesterol ester (ICE), 1,2-dioleoyl-sn-glycero-3-phosphoethanolamine (DOPE), and 1,2-dimyristoyl-sn-glycerol, methoxypolyethylene glycol (DMG-PEG-2K).

In one embodiment, the lipid nanoparticle of the composition comprises a cationic lipid, a steroid; a neutral lipid; and a polymer conjugated lipid, preferably a pegylated lipid. Preferably, the polymer conjugated lipid is a pegylated lipid or PEG-lipid. In a specific embodiment, lipid nanoparticles comprise a cationic lipid resembled by the cationic lipid COATSOME® SS-EC (former name: SS-33/4PE-15; NOF Corporation, Tokyo, Japan), in accordance with the following formula

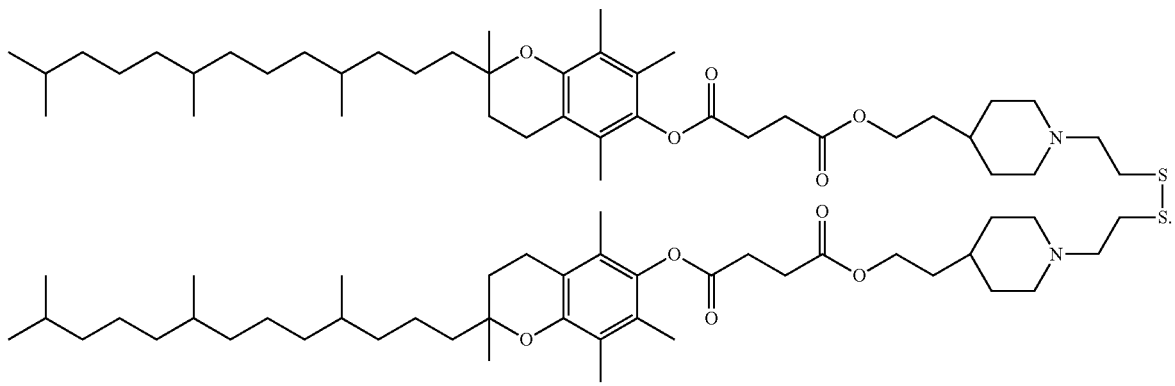 [SMILES: Cc1c(C)c2c(c(C)c1OC(=O)CCC(=O)OCCC1CCN(CCSSCCN3CCC(CCOC(=O)CCC(=O)Oc4c(C)c(C)c5c(c4C)CCC(C)(CCCC(C)CCCC(C)CCCC(C)C)O5)CC3)CC1)CCC(C)(CCCC(C)CCCC(C)CCCC(C)C)O2]

As described further below, those lipid nanoparticles are termed "GN01".

Furthermore, in a specific embodiment, the GN01 lipid nanoparticles comprise a neutral lipid being resembled by the structure 1,2-diphytanoyl-sn-glycero-3-phosphoethanolamine (DPhyPE):

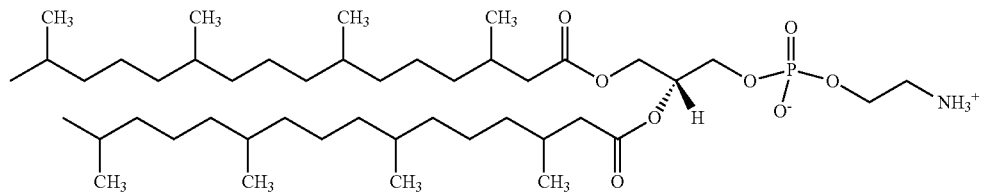 [SMILES: CC(C)CCCC(C)CCCC(C)CCCC(C)CC(=O)OC[C@H](COP(=O)([O-])OCC[NH3+])OC(=O)CC(C)CCCC(C)CCCC(C)CCCC(C)C]

Furthermore, in a specific embodiment, the GN01 lipid nanoparticles comprise a polymer conjugated lipid, preferably a pegylated lipid, being 1,2-dimyristoyl-rac-glycero-3-methoxypolyethylene glycol 2000 (DMG-PEG 2000) having the following structure:

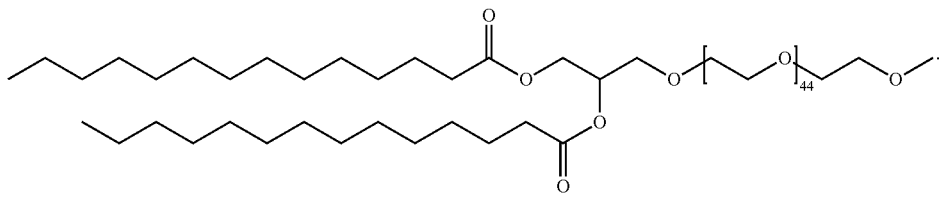

As used in the art, "DMG-PEG 2000" is considered a mixture of 1,2-DMG PEG2000 and 1,3-DMG PEG2000 in ~97:3 ratio.

Accordingly, GN01 lipid nanoparticles (GN01-LNPs) according to one of the preferred embodiments comprise a SS-EC cationic lipid, neutral lipid DPhyPE, cholesterol, and the polymer conjugated lipid (pegylated lipid) 1,2-dimyristoyl-rac-glycero-3-methoxypolyethylene glycol (PEG-DMG).

In a preferred embodiment, the GN01 LNPs comprise:
(a) cationic lipid SS-EC (former name: SS-33/4PE-15; NOF Corporation, Tokyo, Japan) at an amount of 45-65 mol %; (b) cholesterol at an amount of 25-45 mol %;
(c) DPhyPE at an amount of 8-12 mol %; and
(d) PEG-DMG 2000 at an amount of 1-3 mol %;
each amount being relative to the total molar amount of all lipidic excipients of the GN01 lipid nanoparticles.

In a further preferred embodiment, the GN01 lipid nanoparticles as described herein comprises 59 mol % cationic lipid, 10 mol % neutral lipid, 29.3 mol % steroid and 1.7 mol % polymer conjugated lipid, preferably pegylated lipid. In a most preferred embodiment, the GN01 lipid nanoparticles as described herein comprise 59 mol % cationic lipid SS-EC, 10 mol % DPhyPE, 29.3 mol % cholesterol and 1.7 mol % DMG-PEG 2000.

The amount of the cationic lipid relative to that of the nucleic acid in the GN01 lipid nanoparticle may also be expressed as a weight ratio (abbreviated f.e. "m/m"). For example, the GN01 lipid nanoparticles comprise the at least one nucleic acid, preferably the at least one RNA at an amount such as to achieve a lipid to RNA weight ratio in the range of about 20 to about 60, or about 10 to about 50. In other embodiments, the ratio of cationic lipid to nucleic acid or RNA is from about 3 to about 15, such as from about 5 to about 13, from about 4 to about 8 or from about 7 to about 11. In a very preferred embodiment of the present invention, the total lipid/RNA mass ratio is about 40 or 40, i.e. about 40 or 40 times mass excess to ensure RNA encapsulation. Another preferred RNA/lipid ratio is between about 1 and about 10, about 2 and about 5, about 2 and about 4, or preferably about 3.

Further, the amount of the cationic lipid may be selected taking the amount of the nucleic acid cargo such as the RNA compound into account. In one embodiment, the N/P ratio can be in the range of about 1 to about 50. In another embodiment, the range is about 1 to about 20, about 1 to about 10, about 1 to about 5. In one preferred embodiment, these amounts are selected such as to result in an N/P ratio of the GN01 lipid nanoparticles or of the composition in the range from about 10 to about 20. In a further very preferred embodiment, the N/P is 14 (i.e. 14 times mol excess of positive charge to ensure nucleic acid encapsulation).

In a preferred embodiment, GN01 lipid nanoparticles comprise 59 mol % cationic lipid COATSOME® SS-EC (former name: SS-33/4PE-15 as apparent from the examples section; NOF Corporation, Tokyo, Japan), 29.3 mol % cholesterol as steroid, 10 mol % DPhyPE as neutral lipid/ phospholipid and 1.7 mol % DMG-PEG 2000 as polymer conjugated lipid. A further inventive advantage connected with the use of DPhyPE is the high capacity for fusogenicity due to its bulky tails, whereby it is able to fuse at a high level with endosomal lipids. For "GN01", N/P (lipid to nucleic acid, e.g RNA mol ratio) preferably is 14 and total lipid/ RNA mass ratio preferably is 40 (m/m).

In other embodiments, the at least one nucleic acid (e.g. DNA or RNA), preferably the at least one RNA is complexed with one or more lipids thereby forming lipid nanoparticles (LNP), wherein the LNP comprises
I at least one cationic lipid;
Ii at least one neutral lipid;
Iii at least one steroid or steroid analogue; and
Iiii at least one PEG-lipid as defined herein,
wherein the cationic lipid is DLin-KC2-DMA (50 mol %) or DLin-MC3-DMA (50 mol %), the neutral lipid is DSPC (10 mol %), the PEG lipid is PEG-DOMG (1.5 mol %) and the structural lipid is cholesterol (38.5 mol %).

In other embodiments, the at least one nucleic acid (e.g. DNA or RNA), preferably the at least one RNA is complexed with one or more lipids thereby forming lipid nanoparticles (LNP), wherein the LNP comprises SS15/Chol/ DOPE (or DOPC)/DSG-5000 at mol % 50/38.5/10/1.5.

In other embodiments, the nucleic acid of the invention may be formulated in liposomes, e.g. in liposomes as described in WO2019/222424, WO2019/226925, WO2019/ 232095, WO2019/232097, or WO2019/232208, the disclosure of WO2019/222424, WO2019/226925, WO2019/ 232095, WO2019/232097, or WO2019/232208 relating to liposomes or lipid-based carrier molecules herewith incorporated by reference.

In various embodiments, LNPs that suitably encapsulates the at least one nucleic acid of the invention have a mean diameter of from about 50 nm to about 200 nm, from about 60 nm to about 200 nm, from about 70 nm to about 200 nm, from about 80 nm to about 200 nm, from about 90 nm to about 200 nm, from about 90 nm to about 190 nm, from about 90 nm to about 180 nm, from about 90 nm to about 170 nm, from about 90 nm to about 160 nm, from about 90 nm to about 150 nm, from about 90 nm to about 140 nm, from about 90 nm to about 130 nm, from about 90 nm to about 120 nm, from about 90 nm to about 100 nm, from about 70 nm to about 90 nm, from about 80 nm to about 90 nm, from about 70 nm to about 80 nm, or about 30 nm, 35 nm, 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, 150 nm, 160 nm, 170 nm, 180 nm, 190 nm, or 200 nm and are substantially non-toxic. As used herein, the mean diameter may be represented by the z-average as determined by dynamic light scattering as commonly known in the art.

The polydispersity index (PDI) of the nanoparticles is typically in the range of 0.1 to 0.5. In a particular embodiment, a PDI is below 0.2. Typically, the PDI is determined by dynamic light scattering.

In another preferred embodiment of the invention the lipid nanoparticles have a hydrodynamic diameter in the range from about 50 nm to about 300 nm, or from about 60 nm to about 250 nm, from about 60 nm to about 150 nm, or from about 60 nm to about 120 nm, respectively.

In another preferred embodiment of the invention the lipid nanoparticles have a hydrodynamic diameter in the range from about 50 nm to about 300 nm, or from about 60 nm to about 250 nm, from about 60 nm to about 150 nm, or from about 60 nm to about 120 nm, respectively.

In embodiments where more than one or a plurality, e.g. 2, 3, 4, 5, 6, 7, 8, 9, 10, 11, 12, 13, 14, 15 of nucleic acid species of the invention are comprised in the composition, said more than one or said plurality e.g. 2, 3, 4, 5, 6, 7, 8, 9, 10, 11, 12, 13, 14, 15 of nucleic acid species of the invention may be complexed within one or more lipids thereby forming LNPs comprising more than one or a plurality, e.g. 2, 3, 4, 5, 6, 7, 8, 9, 10, 11, 12, 13, 14, 15 of different nucleic acid species.

According to a preferred embodiment the lipid-based carriers preferably encapsulating or comprising RNA are purified by at least one purification step, preferably by at least one step of TFF and/or at least one step of clarification and/or at least one step of filtration. This purification particularly leads to reducing the amount of ethanol in the composition, which has been used for the lipid formulation.

In this context it is particularly preferred that the composition comprises after purification less than about 500 ppM ethanol, preferably less than about 50 ppM ethanol, more preferably less than about 5 ppM ethanol.

In embodiments, the LNPs described herein may be lyophilized in order to improve storage stability of the formulation and/or the nucleic acid, preferably the RNA. In embodiments, the LNPs described herein may be spray dried in order to improve storage stability of the formulation and/or the nucleic acid. Lyoprotectants for lyophilization and or spray drying may be selected from trehalose, sucrose, mannose, dextran and inulin. A preferred lyoprotectant is sucrose, optionally comprising a further lyoprotectant. A further preferred lyoprotectant is trehalose, optionally comprising a further lyoprotectant.

Accordingly, the composition, e.g. the composition comprising LNPs is lyophilized (e.g. according to WO2016/165831 or WO2011/069586) to yield a temperature stable dried nucleic acid (powder) composition as defined herein (e.g. RNA or DNA). The composition, e.g. the composition comprising LNPs may also be dried using spray-drying or spray-freeze drying (e.g. according to WO2016/184575 or WO2016/184576) to yield a temperature stable composition (powder) as defined herein.

Accordingly, in preferred embodiments, the composition is a dried composition.

The term "dried composition" as used herein has to be understood as composition that has been lyophilized, or spray-dried, or spray-freeze dried as defined above to obtain a temperature stable dried composition (powder) e.g. comprising LNP complexed RNA (as defined above).

According to further embodiments, the composition of the second aspect may comprise at least one adjuvant.

Suitably, the adjuvant is preferably added to enhance the immunostimulatory properties of the composition.

The term "adjuvant" as used herein will be recognized and understood by the person of ordinary skill in the art, and is for example intended to refer to a pharmacological and/or immunological agent that may modify, e.g. enhance, the effect of other agents or that may be suitable to support administration and delivery of the composition. The term "adjuvant" refers to a broad spectrum of substances. Typically, these substances are able to increase the immunogenicity of antigens. For example, adjuvants may be recognized by the innate immune systems and, e.g., may elicit an innate immune response (that is, a non-specific immune response). "Adjuvants" typically do not elicit an adaptive immune response. In the context of the invention, adjuvants may enhance the effect of the antigenic peptide or protein provided by the nucleic acid. In that context, the at least one adjuvant may be selected from any adjuvant known to a skilled person and suitable for the present case, i.e. supporting the induction of an immune response in a subject, e.g. in a human subject.

Accordingly, the composition of the second aspect may comprise at least one adjuvant, wherein the at least one adjuvant may be suitably selected from any adjuvant provided in WO2016/203025. Adjuvants disclosed in any of the claims 2 to 17 of WO2016/203025, preferably adjuvants disclosed in claim 17 of WO2016/203025 are particularly suitable, the specific content relating thereto herewith incorporated by reference. Adjuvants may suitably used and comprised in the composition of the second aspect, or the vaccine of the forth aspect, to e.g. reduce the amount of nucleic acid required for a sufficient immune response against the encoded protein and/or to improve the efficacy of the composition/the vaccine for treatment/vaccination of the elderly. A suitable adjuvant in the context of a coronavirus composition or vaccine (in particular for compositions comprising a polypeptide of the third aspect) may be a Toll-like receptor 9 (TLR9) agonist adjuvant, CpG 1018TM.

The composition of the second aspect may comprise, besides the components specified herein, at least one further component which may be selected from the group consisting of further antigens (e.g. in the form of a peptide or protein, preferably derived from a coronavirus) or further antigen-encoding nucleic acids (preferably encoding peptide or protein, preferably derived from a coronavirus); a further immunotherapeutic agent; one or more auxiliary substances (cytokines, such as monokines, lymphokines, interleukins or chemokines); or any further compound, which is known to be immune stimulating due to its binding affinity (as ligands) to human Toll-like receptors; and/or an adjuvant nucleic acid, preferably an immunostimulatory RNA (isRNA), e.g. CpG-RNA etc.

In embodiments, a composition comprising lipid-based carriers encapsulating an RNA is stable after storage as a liquid, for example stable for at least 2 weeks after storage as a liquid at temperatures of about 5° C.

In some aspects, as used herein, "stable" refers to a liquid composition comprising lipid-based carriers encapsulating an RNA where the measured values for various physiochemical parameters are within a defined range after storage. In one embodiment, the liquid composition comprising lipid-based carriers encapsulating an RNA is analyzed to assess stability according to various parameters. Suitable stability parameters include, without limitation, RNA integrity, Z-average particle size, polydispersity index (PDI), the amount of free RNA in the liquid composition, encapsulation efficiency of the RNA (proportion of the RNA in percent incorporated with lipid-based carriers), shape and morphology of the lipid-based carriers encapsulating an RNA, pH, osmolality, or turbidity. Further, "stable" refers to a liquid composition comprising lipid-based carriers encapsulating an RNA where the measured values for various functional parameters are within a defined range after storage. In one embodiment, the liquid composition comprising lipid-based carriers encapsulating an RNA is analyzed to assess the potency of the liquid composition including for example the expression of the encoded peptide or protein, the induction of specific antibody titers, the induction of neutralizing antibody titers, the induction of T-cell, the reactogenicity of the liquid composition including for example the induction of innate immune responses etc.

In preferred embodiments, the term "stable" refers to RNA integrity.

In various embodiments, a composition of the embodiments is defined as a temperature stable liquid pharmaceutical composition and comprises a certain concentration of lipid-based carriers encapsulating an RNA which may be a suitable feature for achieving a temperature stability of the liquid composition. Without whishing to be bound to theory, a certain concentration of the RNA may have advantageous effects on temperature stability of the composition when stored as a liquid.

In embodiments, the concentration of the RNA in a composition is in a range of about 10 µg/ml to about 10 mg/ml. In embodiments, the concentration of the RNA in a liquid composition is in a range of about 100 µg/ml to about 5 mg/ml. In embodiments, the concentration of the RNA in the liquid composition is in a range of about 100 µg/ml to about 2 mg/ml. In embodiments, the concentration of the RNA in a liquid composition is in a range of about 100 µg/ml to about 1 mg/ml. In embodiments, the concentration of the RNA in a liquid composition is in a range of about 200 µg/ml to about 1 mg/ml. In embodiments, the concentration of RNA in a liquid composition is in a range of about 100 µg/ml to about 500 µg/ml. In preferred embodiments, the concentration of RNA in a liquid composition is in a range of about 200 µg/ml to about 500 µg/ml. In preferred embodiments, the concentration of RNA in the liquid composition is in a range of about 200 µg/ml to about 600 µg/ml. In preferred embodiments, the concentration of RNA in the liquid composition is in a range of about 200 µg/ml to about 700 µg/ml. In preferred embodiments, the concentration of RNA in the liquid composition is in a range of about 200 µg/ml to about 800 µg/ml. In preferred embodiments, the concentration of RNA in the liquid composition is in a range of about 200 µg/ml to about 900 µg/ml.

In embodiments, the concentration of RNA in a composition is for example about 100 µg/ml, about 200 µg/ml, about 300 µg/ml, about 400 µg/ml, about 500 µg/ml, about 600 µg/ml, about 700 µg/ml, about 800 µg/ml, about 900 µg/ml, about 1 mg/ml. In preferred embodiments, the concentration of the RNA in the liquid composition is at least 100 µg/ml, preferably at least 200 µg/ml, more preferably at least 500 µg/ml.

In various embodiments, RNA of a pharmaceutical composition has a certain RNA integrity which may be a suitable feature for achieving a temperature stability of the liquid composition.

The term "RNA integrity" generally describes whether the complete RNA sequence is present in the liquid composition. Low RNA integrity could be due to, amongst others, RNA degradation, RNA cleavage, incorrect or incomplete chemical synthesis of the RNA, incorrect base pairing, integration of modified nucleotides or the modification of already integrated nucleotides, lack of capping or incomplete capping, lack of polyadenylation or incomplete polyadenylation, or incomplete RNA in vitro transcription. RNA is a fragile molecule that can easily degrade, which may be caused e.g. by temperature, ribonucleases, pH or other factors (e.g. nucleophilic attacks, hydrolysis etc.), which may reduce the RNA integrity and, consequently, the functionality of the RNA.

The skilled person can choose from a variety of different chromatographic or electrophoretic methods for determining an RNA integrity. Chromatographic and electrophoretic methods are well-known in the art. In case chromatography is used (e.g. RP-HPLC), the analysis of the integrity of the RNA may be based on determining the peak area (or "area under the peak") of the full length RNA in a corresponding chromatogram. The peak area may be determined by any suitable software which evaluates the signals of the detector system. The process of determining the peak area is also referred to as integration. The peak area representing the full length RNA is typically set in relation to the peak area of the total RNA in a respective sample. The RNA integrity may be expressed in % RNA integrity.

In the context of aspects of the invention, RNA integrity may be determined using analytical (RP)HPLC. Typically, a test sample of the liquid composition comprising lipid based carrier encapsulating RNA may be treated with a detergent (e.g. about 2% Triton X100) to dissociate the lipid based carrier and to release the encapsulated RNA. The released RNA may be captured using suitable binding compounds, e.g. Agencourt AMPure XP beads (Beckman Coulter, Brea, Calif., USA) essentially according to the manufacturer's instructions. Following preparation of the RNA sample, analytical (RP)HPLC may be performed to determine the integrity of RNA. Typically, for determining RNA integrity, the RNA samples may be diluted to a concentration of 0.1 g/l using e.g. water for injection (WFI). About 10 µl of the diluted RNA sample may be injected into an HPLC column (e.g. a monolithic poly(styrene-divinylbenzene) matrix). Analytical (RP)HPLC may be performed using standard conditions, for example: Gradient 1: Buffer A (0.1M TEAA (pH 7.0)); Buffer B (0.1 M TEAA (pH 7.0) containing 25% acetonitrile). Starting at 30% buffer B the gradient extended to 32% buffer B in 2 min, followed by an extension to 55% buffer B over 15 minutes at a flow rate of 1 ml/min. HPLC chromatograms are typically recorded at a wavelength of 260 nm. The obtained chromatograms may be evaluated using a software and the relative peak area may be determined in percent (%) as commonly known in the art. The relative peak area indicates the amount of RNA that has 100% RNA integrity. Since the amount of the RNA injected into the HPLC is typically known, the analysis of the relative peak area provides information on the integrity of the RNA. Thus, if e.g. 100 ng RNA have been injected in total, and 100 ng are determined as the relative peak area, the RNA integrity would be 100%. If, for example, the relative peak area would correspond to 80 ng, the RNA integrity would be 80%. Accordingly, RNA integrity in the context of the invention is determined using analytical HPLC, preferably analytical RP-HPLC.

In certain embodiments, a pharmaceutical of the embodiments is stable for about 2 weeks to about 1 month, 2 months, 3 months, 4 months, 5 months, 6 months or 1 year after storage as a liquid at temperatures of about 5° C. For example, at least about 50%, 60%, 70%, 75%, 80%, 85%, 90% or 95% of the RNA remains intact after storage as a liquid for at least about 5° C. for about two weeks, three weeks, one month, 6 weeks, 2 months, 3 months, 4 months, 5 months, 6 months or 1 year. In some aspects, a temperature stable liquid pharmaceutical of the embodiments comprises at least about 70%, 75%, 80%, 85%, 90% or 95% of intact RNA at least about two weeks after storage as a liquid at temperatures of about 5° C. In further aspects, a temperature stable liquid pharmaceutical of the embodiments comprises at least about 70%, 75%, 80%, 85%, 90% or 95% of intact RNA at least 1 month after storage as a liquid at temperatures of about 5° C. In certain aspects, a temperature stable liquid pharmaceutical of the embodiments comprises at least about 70%, 75%, 80%, 85%, 90% or 95% of intact RNA at least about 2 weeks to about 1 month, 2 months, 3 months, 4 months, 5 months, 6 months or 1 year after storage as a liquid at temperatures of about 5° C. In some specific aspects, a temperature stable liquid pharmaceutical of the embodiments comprises at least about 80% of intact RNA after about two weeks of storage as a liquid at temperatures of about 5° C.

In certain embodiments, RNA of a composition has an RNA integrity ranging from about 40% to about 100%. In embodiments, the RNA has an RNA integrity ranging from about 50% to about 100%. In embodiments, the RNA has an RNA integrity ranging from about 60% to about 100%. In embodiments, the RNA has an RNA integrity ranging from about 70% to about 100%. In embodiments, the RNA integrity is for example about 50%, about 60%, about 70%, about 80%, or about 90%. RNA is suitably determined using analytical HPLC, preferably analytical RP-HPLC.

In preferred embodiments, the RNA of a composition has an RNA integrity of at least about 50%, preferably of at least about 60%, more preferably of at least about 70%, most preferably of at least about 80% or ABOUT 90%. RNA is suitably determined using analytical HPLC, preferably analytical RP-HPLC.

In various embodiments, nucleic acid, e.g., RNA of a pharmaceutical composition does not exceed a certain proportion of free RNA, which may be a suitable feature for achieving a temperature stability of the liquid composition. Without wishing to be bound to theory, free RNA in the liquid composition may be more vulnerable to degradation as the RNA that is encapsulated in the lipid based carrier.

In certain aspects, compositions of the embodiments comprise RNA. In this context, the term "free RNA" or "non-complexed RNA" or "non-encapsulated RNA" comprise the RNA molecules that are not encapsulated in the lipid-based carriers as defined herein. During formulation of the liquid composition (e.g. during encapsulation of the RNA into the lipid-based carriers), free RNA may represent a contamination or an impurity. A large proportion of non-encapsulated or free RNA may also be an indicator for destabilization of alipid-based carriers of the composition (e.g. upon storage of the composition). For example, free RNA detectable in the liquid composition may increase during storage, which may be used as a feature to determine the temperature stability of the composition.

The skilled person can choose from a variety of different methods for determining the amount and/or the proportion of free nucleic acid of free RNA in the liquid composition. Free RNA in the liquid composition may be determined by chromatographic methods (e.g. AEX, SEC) or by using probes (e.g. dyes) that bind to free RNA in the composition. In the context of the invention, the amount of free RNA or non-encapsulated RNA may be determined using a dye based assay. Suitable dyes that may be used to determine the amount and/or the proportion of free RNA comprise RiboGreen®, PicoGreen® dye, OliGreen® dye, QuantiFluor® RNA dye, Qubit® RNA dye, Quant-iT™ RNA dye, TOTO®-1 dye, YOYO®-1 dye. Such dyes are suitable to discriminate between free RNA and encapsulated RNA. Reference standards consisting of defined amounts of free RNA or encapsulated RNA may be used and mixed with the respective reagent (e.g. RiboGreen® reagent (Excitation 500 nm/Emission 525 nm)) as recommended by the supplier's instructions. Typically, the free RNA of the liquid composition is quantitated using the Quant-iT RiboGreen RNA Reagent according to the manufacturer's instructions. The proportion of free RNA in the context of the invention is typically determined using a RiboGreen assay.

In embodiments, a composition comprises free nucleic acid, such as free RNA ranging from about 30% to about 0%. In embodiments, the liquid composition comprises about 20% free RNA (and about 80% encapsulated RNA), about 15% free RNA (and about 85% encapsulated RNA), about 10% free RNA (and about 90% encapsulated RNA), or about 5% free RNA (and about 95% encapsulated RNA). In preferred embodiments, the liquid composition comprises less than about 20% free RNA, preferably less than about 15% free RNA, more preferably less than about 10% free RNA, most preferably less than about 5% free RNA.

In aspects comprising RNA nucleic acids, the term "encapsulated RNA" comprise the RNA molecules that are encapsulated in the lipid-based carriers as defined herein. The proportion of encapsulated RNA in the context of the invention is typically determined using a RiboGreen assay.

Accordingly, in embodiments, about 70% to about 100% of the RNA in the liquid composition is encapsulated in the lipid-based carriers. In embodiments, the liquid composition comprises about 80% encapsulated RNA (and about 20% free RNA), about 85% encapsulated RNA (and about 15% free RNA), about 90% encapsulated RNA (and about 10% free RNA), or about 95% encapsulated RNA (and 5% about free RNA).

In preferred embodiments, 80% of the nucleic acid (e.g., RNA) comprised in the liquid composition is encapsulated, preferably 85% of the RNA comprised in the composition is encapsulated, more preferably 90% of the RNA comprised in the composition is encapsulated, most preferably 95% of the RNA comprised in the composition is encapsulated.

In various embodiments, a pharmaceutical composition (in particular the RNA of the composition) does not exceed a certain amount of divalent cations, which may be a suitable feature for achieving temperature stability of the liquid composition. Divalent cations, e.g. divalent metal ions (e.g. $Mg^{2+}$, $Ca^{2+}$, $Mn^{2+}$, $Zn^{2+}$, $Ni^{2+}$, $Fe^{2+}$, $Co^{2+}$, $Pb^{2+}$) may cause hydrolysis of the RNA encapsulated in the lipid-based carriers during storage as a liquid.

In some aspects, RNA of a composition may typically be produced by RNA in vitro transcription (IVT) of a (linear) DNA template. Common RNA in vitro transcription buffers comprise large amounts of $MgCl_2$ (e.g. 5 mM, 15 mM or more) which is a co-factor of the RNA polymerase. Accordingly, the obtained in vitro transcribed RNA may comprise $Mg^{2+}$ ions as a contamination. After RNA in vitro transcription, the DNA template is typically removed by means of DNAses. Common buffers for DNAse digest comprise large amounts of $CaCl_2$) (e.g. 1 mM, 5 mM or more) which is a co-factor of the DNAse. Accordingly, the obtained in vitro transcribed RNA may comprise $Ca^{2+}$ as a contamination.

Typically, various RNA purification steps (e.g. RP-HPLC, tangential flow filtration) may be employed to remove various contaminations including divalent metal ions. Suitably, the RNA used for encapsulation in the lipid-based carriers of the invention has been purified to remove divalent metal ions.

In embodiments, a composition of the embodiments comprises less than about 100 nM divalent cations per g RNA, preferably less than about 50 nM divalent cations per g RNA, more preferably less than about 10 nM divalent cations per g RNA. In embodiments, the divalent cations are selected from $Mg^{2+}$ and/or $Ca^{2+}$. In embodiments, the liquid composition comprises less than about 100 nM $Mg^{2+}$ per g RNA. In embodiments, the liquid composition comprises less than about 100 nM Ca2 per g RNA. Typically, Ion Chromatography (IC) coupled with Inductively Coupled Plasma Mass Spectrometry (IC-ICP-MS) may be used for determination of divalent cations.

In embodiments, the lipid-based carrier encapsulating the RNA of a composition comprises less than about 100 nM divalent cations per g RNA, preferably less than about 50 nM divalent cations per g RNA, more preferably less than about 10 nM divalent cations per g RNA. In embodiments, the divalent cations are selected from Mg2+ and/or Ca2+. In embodiments, the lipid-based carriers encapsulating the RNA comprise less than about 100 nM Mg2+ per g RNA. In embodiments, the lipid-based carriers encapsulating the RNA comprises less than about 100 nM Ca2 per g RNA. Typically, Ion Chromatography (IC) coupled with Inductively Coupled Plasma Mass Spectrometry (IC-ICP-MS) may be used for determination of Mg2+ and/or Ca2+.

In embodiments, the RNA of a composition comprises Na+ as a counter ion. In embodiments, the RNA comprises Na+ in an amount ranging from about 10 µg Na+ per g RNA to about 1 mg Na+ per g RNA. In embodiments, the RNA comprises Na+ as a counter ion in an amount of at least about 100 µg Na+ per g RNA, preferably at least about 200 µg Na+ per g RNA. Typically, Ion Chromatography (IC) coupled with Inductively Coupled Plasma Mass Spectrometry (IC-ICP-MS) may be used for determination of Na+.

In embodiments, the composition comprises at least one antagonist of at least one RNA sensing pattern recognition receptor. Such an antagonist may preferably be co-formulated in lipid-based carriers as defined herein.

Suitable antagonist of at least one RNA sensing pattern recognition receptor are disclosed in PCT patent application PCT/EP2020/072516, the full disclosure herewith incorporated by reference. In particular, the disclosure relating to suitable antagonist of at least one RNA sensing pattern recognition receptors as defined in any one of the claims 1 to 94 of PCT/EP2020/072516 are incorporated.

In preferred embodiments, the composition comprises at least one antagonist of at least one RNA sensing pattern recognition receptor selected from a Toll-like receptor, preferably TLR7 and/or TLR8.

In embodiments, the at least one antagonist of at least one RNA sensing pattern recognition receptor is selected from a nucleotide, a nucleotide analog, a nucleic acid, a peptide, a protein, a small molecule, a lipid, or a fragment, variant or derivative of any of these.

In preferred embodiments, the at least one antagonist of at least one RNA sensing pattern recognition receptor is a single stranded oligonucleotide, preferably a single stranded RNA Oligonucleotide.

In embodiments, the antagonist of at least one RNA sensing pattern recognition receptor is a single stranded oligonucleotide that comprises or consists of a nucleic acid sequence identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 85-212 of PCT/EP2020/072516, or fragments of any of these sequences.

In preferred embodiments, the antagonist of at least one RNA sensing pattern recognition receptor is a single stranded oligonucleotide that comprises or consists of a nucleic acid sequence identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 85-87, 149-212 of PCT/EP2020/072516, or fragments of any of these sequences.

A particularly preferred antagonist of at least one RNA sensing pattern recognition receptor in the context of the invention is 5'-GAG CGmG CCA-3' (SEQ ID NO: 85 of PCT/EP2020/072516), or a fragment thereof.

In embodiments, the molar ratio of the at least one antagonist of at least one RNA sensing pattern recognition receptor as defined herein to the at least one nucleic acid, preferably RNA encoding a SRAS-CoV-2 antigenic peptide or protein as defined herein suitably ranges from about 1:1, to about 100:1, or ranges from about 20:1, to about 80:1.

In embodiments, the wherein the weight to weight ratio of the at least one antagonist of at least one RNA sensing pattern recognition receptor as defined herein to the at least one nucleic acid, preferably RNA encoding a SRAS-CoV-2 antigenic peptide or protein as defined herein suitably ranges from about 1:1, to about 1:30, or ranges from about 1:2, to about 1:10.

Polypeptide for a Coronavirus Vaccine

In a third aspect, the present invention provides an antigenic polypeptide suitable for a coronavirus vaccine, in particular for a SARS-CoV-2 (formerly nCoV-2019) coronavirus vaccine. In preferred embodiments, the polypeptide is derived from any protein or fragment thereof that a nucleic acid of the first aspect is encoding. Preferred polypeptide designs are disclosed in List 1.

In preferred embodiments, the amino acid sequences of the antigenic polypeptide of the third aspect is identical or at least 70%, 80%, 85%, 86%, 87%, 88%, 89%, 90%, 91%, 92%, 93%, 94%, 95%, 96%, 97%, 98%, or 99% identical to any one of amino acid sequences SEQ ID NOs: 1-111, 274-11663, 13176-13510, 13521-14123, 22732-22758, 22917, 22923, 22929-22964, 26938, 26939 or fragment or variant of any of these.

The polypeptide of the third aspect may also be comprised in a (pharmaceutical) composition, including pharmaceutically acceptable carriers, or adjuvants as defined herein, in particular as defined in the context of the second aspect. Accordingly, the invention also relates to a (pharmaceutical) composition comprising said antigenic polypeptide.

The polypeptide of the third aspect may also be comprised in vaccine, including pharmaceutically acceptable carriers, or adjuvants as defined herein, in particular as defined in the context of the fourth aspect. Accordingly, the invention also relates to a vaccine comprising said antigenic polypeptide (see fourth aspect). Suitable adjuvants that may be used in combination with a polypeptide as defined herein are saponin-based adjuvants (steroid or triterpenoid glycosides), e.g. Matrix-M adjuvant.

Vaccine:

In a fourth aspect, the present invention provides a vaccine against a coronavirus, preferably against a SARS-CoV-2 (formerly nCoV-2019) coronavirus causing COVID-19 disease.

In preferred embodiments of the fourth aspect, the vaccine comprises at least one nucleic acid (e.g. DNA or RNA), preferably at least one RNA of the first aspect, or the composition of the second aspect.

In other embodiments, the vaccine comprises at least one polypeptide as defined in the third aspect.

In other embodiments, the vaccine comprises at least one plasmid DNA or adenovirus DNA as defined in the first aspect.

Notably, embodiments relating to the composition of the second aspect may likewise be read on and be understood as suitable embodiments of the vaccine of the fourth aspect. Also, embodiments relating to the vaccine of the fourth aspect may likewise be read on and be understood as suitable embodiments of the composition of the second aspect. Furthermore, features and embodiments described in the context of the first aspect (the nucleic acid of the invention) have to be read on and have to be understood as suitable embodiments of the composition of the fourth aspect.

The term "vaccine" will be recognized and understood by the person of ordinary skill in the art, and is for example intended to be a prophylactic or therapeutic material providing at least one epitope or antigen, preferably an immunogen. In the context of the invention the antigen or antigenic function is suitably provided by the inventive nucleic acid of the first aspect (said nucleic acid comprising a coding sequence encoding a antigenic peptide or protein derived from a SARS-CoV-2 coronavirus) or the composition of the second aspect (comprising at least one nucleic acid of the first aspect). In other embodiments, the antigen or antigenic function is provided by the inventive polypeptide of the third aspect.

In preferred embodiments, the vaccine, or the composition of the second aspect, elicits an adaptive immune response, preferably an adaptive immune response against a coronavirus, preferably against SARS-CoV-2 coronavirus.

In particularly preferred embodiments, the vaccine, or the composition of the second aspect, elicits functional antibodies that can effectively neutralize the virus, preferably SARS-CoV-2 coronavirus.

In further preferred embodiments, the vaccine, or the composition of the second aspect, elicits mucosal IgA immunity by inducing of mucosal IgA antibodies.

In particularly preferred embodiments, the vaccine, or the composition of the second aspect, elicits functional antibodies that can effectively neutralize the virus, preferably SARS-CoV-2 coronavirus.

In further particularly preferred embodiments, the vaccine, or the composition of the second aspect, induces broad, functional cellular T-cell responses against coronavirus, preferably against SARS-CoV-2 coronavirus.

In further particularly preferred embodiments, the vaccine, or the composition of the second aspect, induces a well-balanced B cell and T cell response against coronavirus, preferably against SARS-CoV-2 coronavirus.

According to a preferred embodiment, the vaccine as defined herein may further comprise a pharmaceutically acceptable carrier and optionally at least one adjuvant as specified in the context of the second aspect.

Suitable adjuvants in that context may be selected from adjuvants disclosed in claim 17 of WO2016/203025.

In a preferred embodiment, the vaccine is a monovalent vaccine.

The terms "monovalent vaccine", "monovalent composition" "univalent vaccine" or "univalent composition" will be recognized and understood by the person of ordinary skill in the art, and are e.g. intended to refer to a composition or a vaccine comprising only one antigen or antigen construct from a pathogen. Accordingly, said vaccine or composition comprises only one nucleic acid species encoding a single antigen or antigen construct of a single organism. The term "monovalent vaccine" includes the immunization against a single valence. In the context of the invention, a monovalent SARS-CoV-2 coronavirus vaccine or composition would comprise at least one nucleic acid encoding one single antigenic peptide or protein derived from one specific SARS-CoV-2 coronavirus.

In embodiments, the vaccine is a polyvalent vaccine comprising a plurality or at least more than one of the nucleic acid species defined in the context of the first aspect. Embodiments relating to a polyvalent composition as disclosed in the context of the second aspect may likewise be read on and be understood as suitable embodiments of the polyvalent vaccine.

The terms "polyvalent vaccine", "polyvalent composition" "multivalent vaccine" or "multivalent composition" will be recognized and understood by the person of ordinary skill in the art, and are e.g. intended to refer to a composition or a vaccine comprising antigens from more than one virus (e.g. different SARS-CoV-2 coronavirus isolates), or comprising different antigens or antigen constructs of the same SARS-CoV-2 coronavirus, or any combination thereof. The terms describe that said vaccine or composition has more than one valence. In the context of the invention, a polyvalent SARS-CoV-2 coronavirus vaccine would comprise nucleic acid sequences encoding antigenic peptides or proteins derived from several different SARS-CoV-2 coronavirus (e.g. different SARS-CoV-2 coronavirus isolates) or comprising nucleic acid sequences encoding different antigens or antigen constructs from the same SARS-CoV-2 coronavirus, or a combination thereof.

In preferred embodiments, the polyvalent or multivalent vaccine comprises at least one polyvalent composition as defined in the second aspect. Particularly preferred are polyvalent compositions as defined in section "Multivalent compositions of the invention".

In embodiments, the vaccine comprises at least one antagonist of at least one RNA sensing pattern recognition receptor as defined in the second aspect.

The coronavirus vaccine typically comprises a safe and effective amount of nucleic acid (e.g. DNA or RNA), preferably RNA of the first aspect or composition of the second aspect (or the polypeptide of the third aspect). As used herein, "safe and effective amount" means an amount of nucleic acid or composition sufficient to significantly induce a positive modification of a disease or disorder related to an infection with coronavirus, preferably SARS-CoV-2 coronavirus. At the same time, a "safe and effective amount" is small enough to avoid serious side-effects. In relation to the nucleic acid, composition, or vaccine of the present invention, the expression "safe and effective amount" preferably means an amount of nucleic acid, composition, or vaccine that is suitable for stimulating the adaptive immune system against coronavirus in such a manner that no excessive or damaging immune reactions (e.g. innate immune responses) are achieved.

A "safe and effective amount" of the nucleic acid, composition, or vaccine as defined above will vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the skilled person. Moreover, the "safe and effective amount" of the nucleic acid, the composition, or vaccine may depend from application/delivery route (intradermal, intramuscular, intranasal), application device (jet injection, needle injection, microneedle patch, electroporation device) and/or complexation/formulation (protamine complexation or LNP encapsulation, DNA or RNA). Moreover, the "safe and effective amount" of the nucleic acid, the composition, or the vaccine may depend from the physical condition of the treated subject (infant, pregnant women, immunocompromised human subject etc.).

The coronavirus vaccine can be used according to the invention for human medical purposes and also for veterinary medical purposes (mammals, vertebrates, or avian species).

The pharmaceutically acceptable carrier as used herein preferably includes the liquid or non-liquid basis of the inventive coronavirus vaccine. If the inventive vaccine is provided in liquid form, the carrier will be water, typically pyrogen-free water; isotonic saline or buffered (aqueous) solutions, e.g. phosphate, citrate etc. buffered solutions. Preferably, Ringer-Lactate solution is used as a liquid basis for the vaccine or the composition according to the invention as described in WO2006/122828, the disclosure relating to suitable buffered solutions incorporated herewith by reference. Other preferred solutions used as a liquid basis for the vaccine or the composition, in particular for compositions/vaccines comprising LNPs, comprise sucrose and/or trehalose.

The choice of a pharmaceutically acceptable carrier as defined herein is determined, in principle, by the manner, in which the pharmaceutical composition(s) or vaccine according to the invention is administered. The coronavirus vaccine is preferably administered locally. Routes for local administration in general include, for example, topical administration routes but also intradermal, transdermal, subcutaneous, or intramuscular injections or intralesional, intracranial, intrapulmonal, intracardial, intraarticular and sublingual injections. More preferably, composition or vaccines according to the present invention may be administered by an intradermal, subcutaneous, or intramuscular route, preferably by injection, which may be needle-free and/or needle injection. Preferred in the context of the invention is intramuscular injection. Compositions/vaccines are therefore preferably formulated in liquid or solid form. The suitable amount of the vaccine or composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4.

The inventive coronavirus vaccine or composition as defined herein may comprise one or more auxiliary substances or adjuvants as defined above in order to further increase the immunogenicity. A synergistic action of the nucleic acid contained in the inventive composition/vaccine and of an auxiliary substance, which may be optionally be co-formulated (or separately formulated) with the inventive vaccine or composition as described above, is preferably achieved thereby. Such immunogenicity increasing agents or compounds may be provided separately (not co-formulated with the inventive vaccine or composition) and administered individually.

The coronavirus vaccine is preferably provided in lyophilized or spray-dried form (as described in the context of the second aspect). Such a lyophilized or spray-dried vaccine is typically comprises trehalose and/or sucrose and is re-constituted in a suitable liquid buffer before administration to a subject. In some aspects, a lyophilized vaccine of the embodiments comprises mRNA of the embodiments complexed with LNPs. In some aspects, a lyophilized composition has a water content of less than about 10%. For example, a lyophilized composition can have a water content of about 0.1% to 10%, 0.1% to 7.5%, or 0.5% to 7.5%, preferably the lyophilized composition has a water content of about 0.5% to about 5.0%.

In preferred embodiments administration of a therapeutically effective amount of the nucleic acid, the composition, the polypeptide, the vaccine to a subject induces a neutralizing antibody titer against SARS-CoV-2 coronavirus in the subject.

In some embodiments, the neutralizing antibody titer is at least 100 neutralizing units per milliliter (NU/mL), at least 500 NU/mL, or at least 1000 NU/mL.

In some embodiments, detectable levels of the coronavirus antigen are produced in the subject at about 1 to about 72 hours post administration of the nucleic acid, the composition, the polypeptide, or the vaccine.

In some embodiments, a neutralizing antibody titer (against coronavirus) of at least 100 NU/ml, at least 500 NU/ml, or at least 1000 NU/ml is produced in the serum of the subject at about 1 day to about 72 days post administration of the nucleic acid, the composition, the polypeptide, or the vaccine.

In some embodiments, the neutralizing antibody titer is sufficient to reduce coronavirus infection by at least 50% relative to a neutralizing antibody titer of an unvaccinated control subject or relative to a neutralizing antibody titer of a subject vaccinated with a live attenuated viral vaccine, an inactivated viral vaccine, or a protein sub unit viral vaccine.

In some embodiments, the neutralizing antibody titer and/or a T cell immune response is sufficient to reduce the rate of asymptomatic viral infection relative to the neutralizing antibody titer of unvaccinated control subjects.

In some embodiments, the neutralizing antibody titer and/or a T cell immune response is sufficient to prevent viral latency in the subject.

In some embodiments, the neutralizing antibody titer is sufficient to block fusion of virus with epithelial cells of the subject.

In some embodiments, the neutralizing antibody titer is induced within 20 days following a single 1 ug-100 ug dose of the nucleic acid, the composition, the polypeptide, or the vaccine, or within 40 days following a second 1 ug-100 µg dose of the nucleic acid, the composition, the polypeptide, or the vaccine.

In preferred embodiments, administration of a therapeutically effective amount of the nucleic acid, the composition, the polypeptide, or the vaccine to a subject induces a T cell immune response against coronavirus in the subject. In preferred embodiments, the T cell immune response comprises a CD4+ T cell immune response and/or a CD8+ T cell immune response.

Kit or Kit of Parts, Application, Medical Uses, Method of Treatment:

In a fifth aspect, the present invention provides a kit or kit of parts suitable for treating or preventing a coronavirus infection. Preferably, said kit or kit of parts is suitable for treating or preventing a coronavirus, preferably a SARS-CoV-2 (formerly nCoV-2019) coronavirus infection.

Notably, embodiments relating to the nucleic acid of the first aspect, the composition of the second aspect, the polypeptide of the third aspect, and the vaccine of the fourth aspect may likewise be read on and be understood as suitable embodiments of the kit or kit of parts of the fifth aspect of the invention.

In preferred embodiments, the kit or kit of parts comprises at least one nucleic acid (e.g. RNA or DNA), preferably at least one RNA of the first aspect, at least one composition of the second aspect, and/or at least one polypeptide of the third aspect, and/or at least one vaccine of the forth aspect.

In embodiments, the kit or kit of parts comprises at least one DNA as defined in the first aspect, e.g. at least one plasmid DNA and/or at least one adenovirus DNA.

In embodiments, the kit or kit of parts comprises at least one polypeptide as defined in the third aspect.

In addition, the kit or kit of parts may comprise a liquid vehicle for solubilising, and/or technical instructions providing information on administration and dosage of the components.

The kit may further comprise additional components as described in the context of the composition of the second aspect, and/or the vaccine of the forth aspect.

The technical instructions of said kit may contain information about administration and dosage and patient groups. Such kits, preferably kits of parts, may be applied e.g. for any of the applications or uses mentioned herein, preferably for the use of the nucleic acid of the first aspect, the composition of the second aspect, the polypeptide of the third aspect, or the vaccine of the forth aspect, for the treatment or prophylaxis of an infection or diseases caused by a coronavirus, preferably SARS-CoV-2 coronavirus, or disorders related thereto.

Preferably, the nucleic acid, the composition, the polypeptide, or the vaccine is provided in a separate part of the kit, wherein the nucleic acid, the composition, the polypeptide, or the vaccine is preferably lyophilised.

The kit may further contain as a part a vehicle (e.g. buffer solution) for solubilising the nucleic acid, the composition, the polypeptide, or the vaccine.

In preferred embodiments, the kit or kit of parts as defined herein comprises Ringer lactate solution.

In preferred embodiments, the kit or kit of parts as defined herein comprises a multidose container for administration of the composition/the vaccine.

Any of the above kits may be used in a treatment or prophylaxis as defined herein. More preferably, any of the above kits may be used as a vaccine, preferably a vaccine against infections caused by a coronavirus, preferably caused by SARS-CoV-2 coronavirus.

In preferred embodiments, the kit or kit of parts comprises the following components:
a) at least one container or vial comprising a composition or SARS-CoV-2 vaccine as defined herein, wherein the composition or SARS-CoV-2 vaccine has a nucleic acid concentration, preferably an RNA concentration in a range of about 100 µg/ml to about 1 mg/ml, preferably in a range of about 100 µg/ml to about 500 µg/ml, e.g. about 270 µg/ml.
b) at least one dilution container or vial comprising a sterile dilution buffer, suitably a buffer comprising NaCl, optionally comprising a preservative;
c) at least one means for transferring the composition or vaccine from the storage container to the dilution container; and
d) at least one syringe for administering the final diluted composition or vaccine to a subject, preferably configured for intramuscular administration to a human subject, wherein the final diluted composition or vaccine has a nucleic acid concentration, preferably an RNA concentration in a range of about 10 µg/ml to about 100 µg/ml, preferably in a range of about 10 µg/ml to about 50 µg/ml, e.g. about 24 µg/ml.

In an embodiment, the kit or kit of parts comprises more than one mRNA-based SARS-CoV-2 composition/vaccine, preferably
- at least one vaccine as defined herein provided in a first vial or container, wherein the vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO. 163, 149 or 24837, preferably formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). Preferably, the nucleic acid, preferably mRNA is not chemically modified.
- at least one further vaccine as defined herein provided in a first vial or container, wherein the composition/vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 23311, 23531, 24851, 23310, 23530, 24850, 23313, 23533, 24853, 23314, 23534, or 24854, preferably formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3 (ALC-0315), DSPC, cholesterol and PEG-lipid of formula (IVa) (with n=49 or with n=45 (ALC-0159)). Preferably, the nucleic acid, preferably mRNA is not chemically modified.

In an embodiment, the kit or kit of parts comprises two different SARS-CoV-2 vaccines for prime vaccination and boost vaccination:
- at least one prime vaccine as defined herein provided in a first vial or container, wherein the vaccine is an mRNA-based SARS-CoV-2 vaccine as defined herein; and
- at least one boost vaccine as defined herein provided in a first vial or container, wherein the composition/vaccine is an adenovirus-based SARS-CoV-2 vaccine as defined herein.

In an embodiment, the kit or kit of parts comprises two different SARS-CoV-2 vaccines for prime vaccination and boost vaccination:
- at least one boost vaccine as defined herein provided in a first vial or container, wherein the vaccine is an mRNA-based SARS-CoV-2 vaccine as defined herein; and
- at least one prime vaccine as defined herein provided in a first vial or container, wherein the composition/vaccine is an adenovirus-based SARS-CoV-2 vaccine as defined herein.

Combination:

A sixth aspect relates to a combination of at least two nucleic acid sequences as defined in the first aspect, at least two compositions as defined in the context of the second aspect, at least two polypeptides as defined in the third aspect, at least two vaccines as defined in the context of the fourth aspect, or at least two kits as defined in the fifth aspect.

In the context of the present invention, the term "combination" preferably means a combined occurrence of at least two components, preferably at least two nucleic acid sequences as defined in the first aspect, at least two compositions as defined in the context of the second aspect, at least two polypeptides as defined in the third aspect, at least two vaccines as defined in the context of the fourth aspect, or at least two kits as defined in the fifth aspect. The components of such a combination may occur as separate entities. Thus, the administration of the components of the combination may occur either simultaneously or timely staggered, either at the same site of administration or at different sites of administration.

Notably, embodiments relating to the nucleic acid of the first aspect, the composition of the second aspect, the polypeptide of the third aspect, and the vaccine of the fourth aspect, or the kit or kit of parts of the fifth aspect may likewise be read on and be understood as suitable embodiments of the components of the combination of the sixth aspect.

In embodiments, the combination may comprise a plurality or at least more than one of the nucleic acid species, e.g. RNA species as defined in the context of the first aspect of the invention, wherein the nucleic acid species are provided as separate components.

Preferably, the combination as defined herein may comprise 2, 3, 4, 5, 6, 7, 8, 9, or 10 different nucleic acids e.g. RNA species as defined in the context of the first aspect of the invention; 2, 3, 4, 5, 6, 7, 8, 9, or 10 different compositions as defined in the context of the second aspect of the invention; 2, 3, 4, 5, 6, 7, 8, 9, or 10 different polypeptides as defined in the context of the third aspect of the invention; 2, 3, 4, 5, 6, 7, 8, 9, or 10 different vaccines as defined in the context of the third aspect of the invention, wherein the nucleic acid species, compositions, polypeptides, vaccines are provided as separate components.

In embodiments, the combination comprises 2, 3, 4 or 5 nucleic acid species (e.g. DNA or RNA) comprised in separate components, preferably RNA species, wherein said nucleic acid species comprise or consist of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 116-132, 134-138, 140-143, 145-175, 11664-11813, 11815, 11817-12050, 12052, 12054-13147, 13514, 13515, 13519, 13520, 14124-14177, 22759, 22764-22786, 22791-22813, 22818-22839, 22969-23184, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 and, optionally, at least one pharmaceutically acceptable carrier or excipient, wherein each of the 2, 3, 4 or 5 nucleic acid species encode a different antigenic peptide or protein of a SARS-CoV-2 coronavirus.

Accordingly, in embodiments, the combination comprises two nucleic acid species (e.g. DNA or RNA)) comprised in separate components, preferably RNA species, wherein the nucleic acid species comprise or consist of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 148-175, 12204-13147, 14142-14177, 22786-22839, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937148 and, optionally, at least one pharmaceutically acceptable carrier or excipient, wherein each of the two nucleic acid species encode a different antigenic peptide or protein of a SARS-CoV-2 coronavirus.

In embodiments, the combination comprises three nucleic acid species (e.g. DNA or RNA)) comprised in separate components, preferably RNA species, wherein the nucleic acid comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 148-175, 12204-13147, 14142-14177, 22786-22839, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 and, optionally, at least one pharmaceutically acceptable carrier or excipient, wherein each of the 2, 3, 4 or 5 nucleic acid species encode a different antigenic peptide or protein of a SARS-CoV-2 coronavirus.

In the following, particularly preferred embodiments of a combination are provided, wherein each component of the combination is provided as separate entities.

Preferably, the at least 2, 3, 4, 5, 6, 7, 8, 9, 10 or even more different nucleic acid species, compositions, vaccines of the combination each encode a different prefusion stabilized spike protein (as defined in the first aspect). Preferably, stabilization of the perfusion conformation is obtained by introducing two consecutive proline substitutions at residues K986 and V987 in the spike protein (Amino acid positions according to reference SEQ ID NO: 1). Accordingly, in preferred embodiments, the at least 2, 3, 4, 5, 6, 7, 8, 9, 10 pre-fusion stabilized spike proteins (S_stab) each comprises at least one pre-fusion stabilizing mutation, wherein the at least one pre-fusion stabilizing mutation comprises the following amino acid substitutions: K986P and V987P (amino acid positions according to reference SEQ ID NO: 1).

Accordingly, the at least 2, 3, 4, 5, 6, 7, 8, 9, 10 or even more different nucleic acid species, compositions, vaccines of the combination each encode a different prefusion stabilized spike protein, wherein the at least 2, 3, 4, 5, 6, 7, 8, 9, 10 or even more stabilized spike proteins are selected from amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10-26, 341-407, 609-1278, 13521-13587, 22738, 22740, 22742, 22744, 22746, 22748, 22750, 22752, 22754, 22756, 22758, 22947-2296410 or an immunogenic fragment or immunogenic variant of any of these.

In preferred embodiments, the combination comprises one nucleic acid species, composition, vaccine comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10, wherein the multivalent composition additionally comprises at least 2, 3, 4 further RNA species selected from i) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22961; and/or ii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22960; and/or iii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22963; and/or
iv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22941; and/or
v) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22964.

Preferably, the at least 2, 3, 4, 5, 6, 7, 8, 9, 10 or even more different nucleic acid species, composition, vaccine of the combination comprise nucleic acid coding sequences each encoding a different prefusion stabilized spike protein, wherein the at least 2, 3, 4, 5, 6, 7, 8, 9, 10 or even more nucleic acid coding sequences are selected from nucleic acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 136-138, 140-143, 145-175, 11731-11813, 11815, 11817-12050, 12052, 12054-12203, 13514, 13515, 13519, 13520, 14124-14141, 22759, 22764-22785, 22969-23184 or fragments or variants of any of these.

In preferred embodiments, the combination comprises one nucleic acid species, composition, vaccine comprising a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 137, wherein the multivalent composition additionally comprises at least 2, 3, 4 further RNA species selected from
i) one nucleic acid species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23091; and/or
ii) one nucleic acid species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23090; and/or
iii) one nucleic acid species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23093; and/or
iv) one nucleic acid species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 22999; and/or
v) one nucleic acid species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23094.

Preferably, the at least 2, 3, 4, 5, 6, 7, 8, 9, 10 or even more different nucleic acid species, compositions, vaccines of the combination comprise nucleic acid coding sequences each encoding a different prefusion stabilized spike protein, wherein the at least 2, 3, 4, 5, 6, 7, 8, 9, 10 or even more nucleic acid coding sequences are selected from RNA sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 149-151, 163-165, 12338, 12541, 12810-12813, 12901, 12931, 13013, 22792, 22794, 22796, 22798, 22802, 22804, 22806, 22810, 22813, 22819, 22821, 22823, 22825, 22827, 22829, 22831, 22833, 22835, 22837, 22839, 23297-23314, 23369, 23517-23520, 23523-23525, 23527, 23529, 23530, 23589, 23737, 23957, 24397, 24837, 25057, 25277, 25717, 26925-26937149 or fragments or variants of any of these.

In preferred embodiments, the combination comprises one RNA species, compositions, vaccines comprising or consisting of an RNA sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 163, wherein the combination additionally comprises at least 2, 3, 4 further RNA species selected from
i) one RNA species comprising or consisting of an RNA sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23311; and/or
ii) one RNA species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23310; and/or
iii) one RNA species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23313; and/or
iv) one RNA species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23219; and/or
v) one RNA species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23314;
wherein, preferably, each of the mRNA species comprise a Cap1 structure, and, optionally, each of the mRNA species do not comprise modified nucleotides.

In preferred embodiments, the combination comprises one RNA species, composition, vaccine comprising or consisting of an RNA sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 149 or 24837, wherein the combination additionally comprises at least 2, 3, 4 further RNA species, selected from
i) one RNA species comprising or consisting of an RNA sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23531 or 24851; and/or
ii) one RNA species comprises a coding sequence identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23530 or 24850; and/or
iii) one RNA species comprises a coding sequence identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23533 or 24853B; and/or
iv) one RNA species comprises a coding sequence identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23439 or 24759; and/or v) one RNA species comprises a coding sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23534 or 24854;

wherein, preferably, each of the mRNA species comprise a Cap1 structure, and, optionally, each of the mRNA species do not comprise modified nucleotides.

In a specific embodiment, a first component of the combination comprises a viral vector vaccine/composition, such as an adenovirus vector based vaccine, e.g., ADZ1222 or Ad26.COV-2.S, and a second component comprises a nucleic acid based vaccine/composition, preferably an mRNA-based vaccine as defined herein.

First and Second/Further Medical Use:

A further aspect relates to the first medical use of the provided nucleic acid, composition, polypeptide, vaccine, kit, or combination.

Notably, embodiments relating to the nucleic acid of the first aspect, the composition of the second aspect, the polypeptide of the third aspect, and the vaccine of the fourth aspect, or the kit or kit of parts of the fifth aspect, or the combination may likewise be read on and be understood as suitable embodiments of medical uses of the invention.

Accordingly, the invention provides at least one nucleic acid (e.g. DNA or RNA), preferably RNA as defined in the first aspect for use as a medicament, the composition as defined in the second aspect for use as a medicament, the polypeptide as defined in the third aspect for use as a medicament, the vaccine as defined in the fourth aspect for use as a medicament, and the kit or kit of parts as defined in the fifth aspect for use as a medicament, and the combination.

The present invention furthermore provides several applications and uses of the nucleic acid, composition, polypeptide, vaccine, or kit, or combination.

In particular, nucleic acid (preferably RNA), composition, polypeptide, vaccine, or kit, or combination may be used for human medical purposes and also for veterinary medical purposes, preferably for human medical purposes.

In particular, nucleic acid (preferably RNA), composition, polypeptide, vaccine, or kit or kit of parts or combination is for use as a medicament for human medical purposes, wherein said nucleic acid (preferably RNA), composition, polypeptide, vaccine, or kit or kit of parts may be suitable for young infants, newborns, immunocompromised recipients, as well as pregnant and breast-feeding women and elderly people. In particular, nucleic acid (preferably RNA), composition, polypeptide, vaccine, or kit or kit of parts is for use as a medicament for human medical purposes, wherein said nucleic acid (preferably RNA), composition, polypeptide, vaccine, or kit or kit of parts is particularly suitable for elderly human subjects.

Said nucleic acid (preferably RNA), composition, polypeptide, vaccine, or kit or combination is for use as a medicament for human medical purposes, wherein said RNA, composition, vaccine, or the kit or kit of parts may be particularly suitable for intramuscular injection or intradermal injection.

In yet another aspect, the invention relates to the second medical use of the provided nucleic acid, composition, polypeptide, vaccine, or kit or combination.

Accordingly, the invention provides at least one nucleic acid, preferably RNA as defined in the first aspect for treatment or prophylaxis of an infection with a coronavirus, preferably SARS-CoV-2 coronavirus, or a disorder or a disease related to such an infection, such as COVID-19; a composition as defined in the second aspect for treatment or prophylaxis of an infection with a coronavirus, preferably SARS-CoV-2 coronavirus, or a disorder or a disease related to such an infection, such as COVID-19; a polypeptide as defined in the third aspect for treatment or prophylaxis of an infection with a coronavirus, preferably SARS-CoV-2 coronavirus, or a disorder or a disease related to such an infection, such as COVID-19; a vaccine as defined in the fourth aspect for treatment or prophylaxis of an infection with a coronavirus, preferably SARS-CoV-2 coronavirus, or a disorder or a disease related to such an infection, such as COVID-19; a kit or kit of parts as defined in the fifth aspect for treatment or prophylaxis of an infection with a coronavirus, preferably SARS-CoV-2 coronavirus, or a disorder or a disease related to such an infection, such as COVID-19; a combination as defined in the sixth aspect for treatment or prophylaxis of an infection with a coronavirus, preferably SARS-CoV-2 coronavirus, or a disorder or a disease related to such an infection, such as COVID-19.

In embodiments, the nucleic acid, preferably RNA of the first aspect, the composition of the second aspect, the polypeptide of the third aspect, the vaccine of the fourth aspect, or the kit or kit of parts of the fifth aspect, or the combination of the sixth aspect, is for use in the treatment or prophylaxis of an infection with a coronavirus, preferably with SARS-CoV-2 coronavirus.

Particularly, the nucleic acid, preferably RNA of the first aspect, the composition of the second aspect, the polypeptide of the third aspect, the vaccine of the fourth aspect, or the kit or kit of parts of the fifth aspect, or the combination of the sixth aspect, may be used in a method of prophylactic (pre-exposure prophylaxis or post-exposure prophylaxis) and/or therapeutic treatment of infections caused by a coronavirus, preferably SARS-CoV-2 coronavirus.

Particularly, the nucleic acid, preferably RNA of the first aspect, the composition of the second aspect, the polypeptide of the third aspect, the vaccine of the fourth aspect, or the kit or kit of parts of the fifth aspect, or the combination of the sixth aspect, may be used in a method of prophylactic (pre-exposure prophylaxis or post-exposure prophylaxis) and/or therapeutic treatment of COVID-19 disease caused by a SARS-CoV-2 coronavirus infection.

The nucleic acid, the composition, the polypeptide, or the vaccine, or the combination may preferably be administered locally. In particular, composition or polypeptides or vaccines or combinations may be administered by an intradermal, subcutaneous, intranasal, or intramuscular route. In embodiments, the inventive nucleic acid, composition, polypeptide, vaccine may be administered by conventional needle injection or needle-free jet injection. Preferred in that context is intramuscular injection.

In embodiments where plasmid DNA is used and comprised in the composition or vaccine or combination, the composition/vaccine/combination may be administered by electroporation using an electroporation device, e.g. an electroporation device for intradermal or intramuscular delivery. Suitably, a device as described in U.S. Pat. No. 7,245,963B2 may be used, in particular a device as defined by claims 1 to 68 of U.S. Pat. No. 7,245,963B2.

In embodiments where adenovirus DNA is used and comprised in the composition or vaccine or combination, the composition/vaccine/combination may be administered by intranasal administration.

In embodiments, the nucleic acid as comprised in a composition or vaccine or combination as defined herein is provided in an amount of about 100 ng to about 500 ug, in an amount of about 1 ug to about 200 ug, in an amount of about 1 ug to about 100 ug, in an amount of about 5 ug to about 100 ug, preferably in an amount of about 10 ug to about 50 ug, specifically, in an amount of about 1 ug, 2 ug, 3 ug, 4 ug, 5 ug, 8 ug, 9 ug, 10 ug, 11 ug, 12 ug, 13 ug, 14 ug, 15 ug, 16 ug 20 ug, 25 ug, 30 ug, 35 ug, 40 ug, 45 ug, 50 ug, 55 ug, 60 ug, 65 ug, 70 ug, 75 ug, 80 ug, 85 ug, 90 ug, 95 ug or 100 ug.

In some embodiments, the vaccine comprising the nucleic acid, or the composition comprising the nucleic acid is formulated in an effective amount to produce an antigen specific immune response in a subject. In some embodiments, the effective amount of nucleic acid is a total dose of 1 ug to 200 ug, 1 ug to 100 ug, or 5 ug to 100 ug.

In embodiments where the nucleic acid is provided in a lipid-based carrier, e.g. an LNP, the amount of PEG-lipid as defined herein comprised in one dose is lower than about 50 μg PEG lipid, preferably lower than about 45 μg PEG lipid, more preferably lower than about 40 μg PEG lipid.

Having a low amount of PEG lipid in one dose may reduce the risk of adverse effects (e.g. allergies).

In particularly preferred embodiments, the amount of PEG-lipid comprised in one dose is in a range from about 3.5 μg PEG lipid to about 35 μg PEG lipid.

In embodiments where the nucleic acid is provided in a lipid-based carrier, e.g. an LNP, the amount of cationic lipid as defined herein comprised in one dose is lower than about 400 μg cationic lipid, preferably lower than about 350 μg cationic lipid, more preferably lower than about 300 μg cationic lipid.

Having a low amount of cationic lipid in one dose may reduce the risk of adverse effects (e.g. fewer).

In particularly preferred embodiments, the amount of cationic-lipid comprised in one dose is in a range from about 30 μg PEG lipid to about 300 μg PEG lipid.

In one embodiment, the immunization protocol for the treatment or prophylaxis of a subject against coronavirus, preferably SARS-CoV-2 coronavirus comprises one single doses of the composition or the vaccine.

In some embodiments, the effective amount is a dose of 1 ug administered to the subject in one vaccination. In some embodiments, the effective amount is a dose of 2 ug administered to the subject in one vaccination. In some embodiments, the effective amount is a dose of 3 ug administered to the subject in one vaccination. In some embodiments, the effective amount is a dose of 4 ug administered to the subject in one vaccination. In some embodiments, the effective amount is a dose of 5 ug administered to the subject in one vaccination. 6 ug administered to the subject in one vaccination. In some embodiments, the effective amount is a dose of 7 ug administered to the subject in one vaccination. In some embodiments, the effective amount is a dose of 8 ug administered to the subject in one vaccination. In some embodiments, the effective amount is a dose of 9 ug administered to the subject in one vaccination. In some embodiments, the effective amount is a dose of 10 ug administered to the subject in one vaccination. In some embodiments, the effective amount is a dose of 11 ug administered to the subject in one vaccination. In some embodiments, the effective amount is a dose of 12 ug administered to the subject in one vaccination. In some embodiments, the effective amount is a dose of 13 ug administered to the subject in one vaccination. In some embodiments, the effective amount is a dose of 14 ug administered to the subject in one vaccination. In some embodiments, the effective amount is a dose of 16 ug administered to the subject in one vaccination. In some embodiments, the effective amount is a dose of 20 ug administered to the subject in one vaccination. In some embodiments, the effective amount is a dose of 25 ug administered to the subject in one vaccination. In some embodiments, the effective amount is a dose of 30 ug administered to the subject in one vaccination. In some embodiments, the effective amount is a dose of 40 ug administered to the subject in one vaccination. In some embodiments, the effective amount is a dose of 50 ug administered to the subject in one vaccination. In some embodiments, the effective amount is a dose of 100 ug administered to the subject in one vaccination. In some embodiments, the effective amount is a dose of 200 ug administered to the subject in one vaccination. A "dose" in that context relates to the effective amount of nucleic acid, preferably mRNA as defined herein.

In preferred embodiments, the immunization protocol for the treatment or prophylaxis of a coronavirus, preferably a SARS-CoV-2 coronavirus infection comprises a series of single doses or dosages of the composition or the vaccine. A single dosage, as used herein, refers to the initial/first dose, a second dose or any further doses, respectively, which are preferably administered in order to "boost" the immune reaction.

In some embodiments, the effective amount is a dose of 1 ug administered to the subject a total of two times. In some embodiments, the effective amount is a dose of 2 ug administered to the subject a total of two times. In some embodiments, the effective amount is a dose of 3 ug administered to the subject a total of two times. In some embodiments, the effective amount is a dose of 4 ug administered to the subject a total of two times. In some embodiments, the effective amount is a dose of 5 ug administered to the subject a total of two times. In some embodiments, the effective amount is a dose of 6 ug administered to the subject a total of two times. In some embodiments, the effective amount is a dose of 7 ug administered to the subject a total of two times. In some embodiments, the effective amount is a dose of 8 ug administered to the subject a total of two times. In some embodiments, the effective amount is a dose of 9 ug administered to the subject a total of two times. In some embodiments, the effective amount is a dose of 10 ug administered to the subject a total of two times. In some embodiments, the effective amount is a dose of 11 ug administered to the subject a total of two times. In some embodiments, the effective amount is a dose of 12 ug administered to the subject a total of two times. In some embodiments, the effective amount is a dose of 13 ug administered to the subject a total of two times. In some embodiments, the effective amount is a dose of 14 ug administered to the subject a total of two times. In some embodiments, the effective amount is a dose of 16 ug administered to the subject a total of two times. In some embodiments, the effective amount is a dose of 20 ug administered to the subject a total of two times. In some embodiments, the effective amount is a dose of 25 ug administered to the subject a total of two times. In some embodiments, the effective amount is a dose of 30 ug administered to the subject a total of two times. In some embodiments, the effective amount is a dose of 40 ug administered to the subject a total of two times. In some embodiments, the effective amount is a dose of 50 ug administered to the subject a total of two times. In some embodiments, the effective amount is a dose of 100 ug administered to the subject a total of two times. In some embodiments, the effective amount is a dose of 200 ug administered to the subject a total of two times. A "dose" in that context relates to the effective amount of nucleic acid, preferably mRNA as defined herein.

In preferred embodiments, the vaccine/composition/combination immunizes the subject against a coronavirus, preferably against a SARS-CoV-2 coronavirus infection (upon administration as defined herein) for at least 1 year, preferably at least 2 years. In preferred embodiments, the vaccine/composition/combination immunizes the subject against a coronavirus, preferably against a SARS-CoV-2 coronavirus for more than 2 years, more preferably for more than 3 years, even more preferably for more than 4 years, even more preferably for more than 5-10 years.

Method of Treatment and Use, Diagnostic Method and Use:

In another aspect, the present invention relates to a method of treating or preventing a disorder.

Notably, embodiments relating to the nucleic acid of the first aspect, the composition of the second aspect, the polypeptide of the third aspect, and the vaccine of the fourth aspect, the kit or kit of parts of the fifth aspect, the combination of the sixth aspect, or medical uses may likewise be read on and be understood as suitable embodiments of methods of treatments as provided herein. Furthermore, specific features and embodiments relating to method of treatments as provided herein may also apply for medical uses of the invention.

Preventing (Inhibiting) or treating a disease, in particular a coronavirus infection relates to inhibiting the full development of a disease or condition, for example, in a subject who is at risk for a disease such as a coronavirus infection. "Treatment" refers to a therapeutic intervention that ameliorates a sign or symptom of a disease or pathological condition after it has begun to develop. The term "ameliorating", with reference to a disease or pathological condition, refers to any observable beneficial effect of the treatment. Inhibiting a disease can include preventing or reducing the risk of the disease, such as preventing or reducing the risk of viral infection. The beneficial effect can be evidenced, for example, by a delayed onset of clinical symptoms of the disease in a susceptible subject, a reduction in severity of some or all clinical symptoms of the disease, a slower progression of the disease, a reduction in the viral load, an improvement in the overall health or well-being of the subject, or by other parameters that are specific to the particular disease. A "prophylactic" treatment is a treatment administered to a subject who does not exhibit signs of a disease or exhibits only early signs for the purpose of decreasing the risk of developing pathology.

In preferred embodiments, the present invention relates to a method of treating or preventing a disorder, wherein the method comprises applying or administering to a subject in need thereof at least one nucleic acid of the first aspect, the composition of the second aspect, the polypeptide of the third aspect, the vaccine of the fourth aspect, or the kit or kit of parts of the fifth aspect, or the combination of the sixth aspect.

In preferred embodiments, the disorder is an infection with a coronavirus, or a disorder related to such infections, in particular an infection with SARS-CoV-2 coronavirus, or a disorder related to such infections, e.g. COVID-19.

In preferred embodiments, the present invention relates to a method of treating or preventing a disorder as defined above, wherein the method comprises applying or administering to a subject in need thereof at least one nucleic acid of the first aspect, the composition of the second aspect, the polypeptide of the third aspect, the vaccine of the fourth aspect, or the kit or kit of parts of the fifth aspect, or the combination of the sixth aspect, wherein the subject in need is preferably a mammalian subject.

In certain embodiments, a method of treating or preventing disease by applying or administering to a subject in need thereof at least one nucleic acid of the first aspect, the composition of the second aspect, the polypeptide of the third aspect, the vaccine of the fourth aspect, or the kit or kit of parts of the fifth aspect or the combination of the sixth aspect, is further defined as a method of reducing disease burden in the subject. For example, the method preferably reduces the severity and/or duration of one or more symptom of COVID-19 disease. In some aspects, a method reduces the probability that a subject will require hospital admission, intensive care unit admission, treatment with supplemental oxygen and/or treatment with a ventilator. In further aspects, the method reduces the probability that a subject will develop a fever, breathing difficulties; loss of smell and/or loss of taste. In preferred aspects, the method reduces the probability that a subject will develop severe or moderate COVID-19 disease. In certain aspects, a method of the embodiments prevents severe or moderate COVID-19 disease in the subject between about 2 weeks and 1 month, 2 months, 3 months, 4 months, 5 months, 6 months, 1 year or 2 years after the subject is administered a composition of the embodiments. In preferred aspects, a method of the embodiments prevents symptomatic COVID-19 disease. In further aspects, a method of the embodiment prevents detectable levels of SARS CoV-2 nucleic acid in the subject between about 2 weeks and 1 month, 2 months, 3 months, 4 months, 5 months, 6 months, 1 year or 2 years after the subject is administered a composition of the embodiments. In further aspects, a method of the embodiments is defined as a method for providing protective immunity to a coronavirus infection (e.g., SARS CoV-2 infection) in the subject. In still further aspects, a method of the embodiments prevents moderate and severe COVID-19 disease in at least 80%, 85%, 90% or 95% of treated subjects. In yet further aspects, a method of the embodiments prevents moderate and severe COVID-19 disease in at least 80%, 85%, 90% or 95% of treated subjects from about 2 weeks to about 1 year after administering the second or subsequent immunogenic composition (e.g., a booster administration). In yet further aspects, a method of the embodiments prevents moderate and severe COVID-19 disease in at least 80%, 85%, 90% or 95% of treated subjects from about 2 weeks to about 3 month, 6 months, 9 months, 1 year, 1.5 years, 2 years or 3 years after administering the second or subsequent composition.

In a further aspects, a method of the embodiments comprises (i) obtaining a composition (e.g., a vaccine composition) of the embodiments, wherein the composition is lyophilized; (ii) solubilizing the lyophilized composition in a pharmaceutically acceptable liquid carrier to produce a liquid composition; and (iii) administering an effective amount of the liquid composition to the subject. In some aspects, the lyophilized composition comprises less than about 10% water content. For example, the lyophilized composition can preferably comprise about 0.1% to about 10%, 0.5% to 7.5% or 0.5% to 5.0% water.

In still further aspects, a method of the embodiments comprises administering a vaccine composition comprising a mRNA at least about 95% identical to SEQ ID NO: 163 (e.g., in complex with a LNP) to a subject.

In further aspects, a method of the embodiments comprises administering a vaccine composition comprising a mRNA at least about 95% identical to SEQ ID NO: 149, 24837, 23311, 23531, 23310, 23530, 23313, or 23533 (e.g., in complex with a LNP) to a subject. In some aspects, such a method provides a sufficient immune response in the subject to protect the subject from severe COVID-19 disease for at least about 6 months. For example, in some aspects, the subject is protected from severe COVID-19 disease for about 6 months to about 1 year, 1.5 years, 2 years, 2.5 years, 3 years, 4 years or 5 years. Thus, in some aspects, a method of the embodiments provides a single dose vaccine composition that can provide prolonged (e.g., greater than 6 months of) protection from severe disease to a subject.

As used herein severe COVID-19 disease is defined as a subject experiencing one or more of the following:
Clinical signs at rest indicative of severe systemic illness (respiratory rate≥30 breaths per minute, heart rate≥125 per minute, SpO2≤93% on room air at sea level or PaO2/FIO2<300 mm Hg (adjusted according to altitude))
Respiratory failure (defined as needing high flow-oxygen, noninvasive ventilation, mechanical ventilation or ECMO)
Evidence of shock (SBP<90 mm Hg, DBP<60 mmHg, or requiring vasopressors)
Significant renal, hepatic, or neurologic dysfunction
Admission to ICU
Death As used herein moderate COVID-19 disease is defined as a subject experiencing one or more of the following:
Shortness of breath or difficulty breathing
Respiratory rate≥20 breaths per minute
Abnormal SpO2 but still >93% on room air at sea level (adjusted according to altitude)
Clinical or radiographic evidence of lower respiratory tract disease
Radiologic evidence of deep vein thrombosis (DVT)

As used herein mild COVID-19 disease is defined as a subject experiencing all of the following:
Symptomatic AND
No shortness of breath or difficulty breathing AND
No hypoxemia (adjusted according to altitude) AND
Does not meet the case definition of moderate or severe COVID-19 disease In particularly preferred embodiments, the subject in need is a mammalian subject, preferably a human subject, e.g. newborn, pregnant, immunocompromised, and/or elderly. In some embodiments, the subject between the ages of 6 months and 100 years, 6 months and 80 years, 1 year and 80 years, 1 year and 70 years, 2 years and 80 years or 2 years and 60 years. In other embodiments the subject is a newborn or infant of an age of not more than 3 years, of not more than 2 years, of not more than 1.5 years, of not more than 1 year (12 months), of not more than 9 months, 6 months or 3 months. In some other embodiments the subject is an elderly subject of an age of at least 50, 60, 65, or 70 years. In further aspects, a subject for treatment according to the embodiments is 61 years of age or older. In still further aspects, the subject is 18 years old to 60 years old.

In certain embodiments, a subject for treatment according to the embodiments is a pregnant subject, such a pregnant human. In some aspects, the subject has been pregnant for more than about one month, two months, three months, four months, five months, six months, seven months or eight months.

In particularly preferred embodiments, the human subject is an elderly human subject.

In certain aspects, a subject for treatment according to the embodiments has native American, African, Asian or European heritage. In some aspects, the subject has at least about 10%, 15%, 20%, 25%, 30%, 35%, 40%, 45%, 50%, 55%, 60%, 65%, 70%, 75%, 80%, 85% or 90% native American, African, Asian or European heritage. In certain aspects, the subject has native American heritage, such as at least about 10%, 25% or 50% native American heritage. In further aspects, the subject is an elderly subject having native American heritage, e.g., a subject who is at least 55, 60, 65 or 70 years of age.

In further aspects, a subject for treatment according to the embodiments has a disease or is immune compromised. In some aspects, the subject has liver disease, kidney disease diabetes, hypertension, heart disease or lung disease. In further aspects, a subject for treatment according to the embodiments is a subject with history of allergic reaction, such a subject having food allergies. In some aspect, the subject has had a previous allergic reaction to a vaccine, such as an anaphylactic reaction. In still further aspects, a subject for treatment according to the methods is a subject having detectable anti-PEG antibodies, such as detectable anti-PEG IgE in the serum.

In further aspects, a subject for treatment according to the embodiments has at least one co-morbidity selected from:
(i) Chronic kidney disease: Kidney function will be ascertained from the serum creatinine measurement within the last 3-6 months, converted into estimated glomerular filtration rate (eGFR) using the Chronic Kidney Disease Epidemiology Collaboration (CKD-EPI) equation, with impaired kidney function defined as eGFR<60 mL/min/1.73 m$^2$.
Mild chronic kidney disease is defined as an eGFR between 60 89 mL/min/1.73 m2.
Moderate chronic kidney disease is defined as an eGFR between 31-59 mL/min/1.73 m2 with stable therapy and good maintenance over at least 6 months (modified from Clinical Practice Clinical Guidelines for Chronic Kidney Disease: Am J Kidney Dis, 2002).
(ii) COPD (including emphysema and chronic bronchitis).
Mild COPD with or without cough or sputum production is defined as forced expiratory volume in 1 second/forced vital capacity (FEV1/FVC)<0.7 and FEV1≥80% predicted.
Moderate COPD with or without cough or sputum production is defined as FEV1/FVC<0.7 and FEV1≥250%, but <80% predicted with stable treatment (GOLD Criteria for COPD severity).
(iii) Obesity with body mass index (BMI) of >32 kg/m$^2$—any extreme morbid obesity will also be included.
(iv) Chronic cardiovascular conditions (heart failure, coronary artery disease, cardiomyopathies, arterial hypertension), including the following:
Class I heart failure with potential high risk for developing heart failure in future with no functional or structural heart disorder.
Class II heart failure: subjects with cardiac disease resulting in slight limitation of physical activity. Comfortable at rest.
Ordinary physical activity results in fatigue, palpitation, dyspnea, or anginal pain.
Class III heart failure with marked limitation of physical activity, but comfortable at rest but less than ordinary activity results in symptoms.
A structural heart disorder without symptoms at any stage.
Mild left ventricular systolic or diastolic dysfunction, usually with not much produced clinical signs.

Moderate left ventricular failure with exertional dyspnea or orthopnea or paroxysmal nocturnal dyspnea as per New York Heart Association (NYHA), stable with medication (Class II-Ill).

Coronary artery disease of 2 and above metabolic equivalent threshold (MET) up to moderate, stable with medication. (MET is defined as the amount of oxygen consumed while sitting at rest and is equal to 3.5 ml O2 per kg body weight×min; 4 Normal, can climb a flight of stairs or walk up a hill and can participate in other strenuous activities; 1 can take care of him/herself and may not maintain themselves and gets constraints on exertion.)

Cardiomyopathies of non-infective and metabolic origin of 2-3 MET with medication.

Stage 1 hypertension or Stage 2 hypertension stable and controlled with medications.

(v) Chronic HIV infection with stable aviraemia (<50 copies/mL) and CD4 count>350/mL as documented by blood samples taken within 12 months before enrolment. (Viral load<50 copies/mL with transient changes of 50-350 copies/mL is allowed.)

(vi) Type 2 diabetes mellitus, either controlled with medication [hemoglobin A1c (HbA1c)<58 mmol/mol (7.45%)] or uncontrolled with recent HbA1c of >58 mmol/mol (7.45%); [(HbA1c in %−2.15)×10.929=HbA1c in mmol/mol]; in uncontrolled DM HbA1c should be within <10% variation and should not have any history of diabetic ketoacidosis or episode of severe symptomatic hypoglycemia within prior 3 months.

(vii) Subjects who underwent renal transplant at least a year ago under stable conditions for at least 6 months with medications, categorized as low risk of rejection.

In still further aspects, a subject for treatment according to the embodiments has not been treated with an immunosuppressant drug for more than 14 days in the last 6 months. In some aspects, a subject for treatment according to the embodiments has not received a live vaccine for at least 28 days prior to the administration and/or has not received an inactivated vaccine for at least 14 days prior to the administration. In further aspects a subject for treatment according to the embodiments has NOT:

Had virologically-confirmed COVID-19 illness;

For females: experienced pregnancy or lactation with-in a month prior to administration of the composition of the embodiments;

had treatment with an investigational or non-registered product (e.g., vaccine or drug) within 28 days preceding the administration of the composition of the embodiments;

received a licensed vaccines within 28 days (for live vaccines) or 14 days (for inactivated vaccines) prior to the administration of the composition of the embodiments;

been previously or concurrently treated with any investigational SARS-CoV-2 vaccine or another coronavirus (SARS-CoV, MERS-CoV) vaccine;

been treated with immunosuppressants or other immune-modifying drugs (e.g., corticosteroids, biologicals and methotrexate) for >14 days total within 6 months preceding the administration of the composition of the embodiments;

had any medically diagnosed or suspected immunosuppressive or immunodeficient condition based on medical history and physical examination including known infection with human immunodeficiency virus (HIV), hepatitis B virus (HBV) or hepatitis C virus (HCV); current diagnosis of or treatment for cancer including leukemia, lymphoma, Hodgkin disease, multiple myeloma, or generalized malignancy; chronic renal failure or nephrotic syndrome; and receipt of an organ or bone marrow transplant.

had a history of angioedema (hereditary or idiopathic), or history of any anaphylactic reaction or pIMD.

a history of allergy to any component of CVnCoV vaccine.

been administered of immunoglobulins or any blood products within 3 months prior to the administration of the composition of the embodiments;

experienced a significant acute or chronic medical or psychiatric illness; and/or experienced severe and/or uncontrolled cardiovascular disease, gastrointestinal disease, liver disease, renal disease, respiratory disease, endocrine disorder, and neurological and psychiatric illnesses.

In certain aspects, a subject for treatment according to the methods of the embodiments does not have any potential immune-mediated disease (pIMD). In further aspects, a treatment method of the embodiments does not induce any pIMD in a treated subject. As used herein pIMDs are defined as Celiac disease; Crohn's disease; Ulcerative colitis; Ulcerative proctitis; Autoimmune cholangitis; Autoimmune hepatitis; Primary biliary cirrhosis; Primary sclerosing cholangitis; Addison's disease; Autoimmune thyroiditis (including Hashimoto thyroiditis; Diabetes mellitus type I; Grave's or Basedow's disease; Antisynthetase syndrome; Dermatomyositis; Juvenile chronic arthritis (including Still's disease); Mixed connective tissue disorder; Polymyalgia rheumatic; Polymyositis; Psoriatic arthropathy; Relapsing polychondritis; Rheumatoid arthritis; Scleroderma, (e.g., including diffuse systemic form and CREST syndrome); Spondyloarthritis, (e.g., including ankylosing spondylitis, reactive arthritis (Reiter's Syndrome) and undifferentiated spondyloarthritis); Systemic lupus erythematosus; Systemic sclerosis; Acute disseminated encephalomyelitis, (including site specific variants (e.g., non-infectious encephalitis, encephalomyelitis, myelitis, myeloradiculomyelitis)); Cranial nerve disorders, (e.g., including paralyses/paresis (e.g., Bell's palsy)); Guillain-Barré syndrome, (e.g., including Miller Fisher syndrome and other variants); Immune-mediated peripheral neuropathies, Parsonage-Turner syndrome and plexopathies, (e.g., including chronic inflammatory demyelinating polyneuropathy, multifocal motor neuropathy, and polyneuropathies associated with monoclonal gammopathy); Multiple sclerosis; Narcolepsy; Optic neuritis; Transverse Myelitis; Alopecia areata; Autoimmune bullous skin diseases, including pemphigus, pemphigoid and dermatitis herpetiformis; Cutaneous lupus erythematosus; Erythema nodosum; Morphoea; Lichen planus; Psoriasis; Sweet's syndrome; Vitiligo; Large vessels vasculitis (e.g., including: giant cell arteritis such as Takayasu's arteritis and temporal arteritis); Medium sized and/or small vessels vasculitis (e.g., including: polyarteritis nodosa, Kawasaki's disease, microscopic polyangiitis, Wegener's granulomatosis, Churg-Strauss syndrome (allergic granulomatous angiitis), Buerger's disease thromboangiitis obliterans, necrotizing vasculitis and anti-neutrophil cytoplasmic antibody (ANCA) positive vasculitis (type unspecified), Henoch-Schonlein purpura, Behcet's syndrome, leukocytoclastic vasculitis); Antiphospholipid syndrome; Autoimmune hemolytic anemia; Autoimmune glomerulonephritis (including IgA nephropathy, glomerulonephritis rapidly progressive, membranous glomerulonephritis, membranoproliferative glomerulonephritis, and mesangioproliferative glomerulonephritis); Autoimmune myocarditis/cardiomyopathy; Autoimmune thrombocytopenia; Goodpasture syndrome; Idiopathic pulmonary fibrosis; Pernicious anemia; Raynaud's phenomenon; Sarcoidosis; Sjögren's syndrome; Stevens-Johnson syndrome; Uveitis).

In certain aspects, a vaccination method of the embodiments does not result in a subject experiencing any adverse events of special interest (AESIs). As used herein AESIs are defined as a pIMD listed above; Anaphylaxis; Vasculitides; Enhanced disease following immunization; Multisystem inflammatory syndrome in children; Acute Respiratory Distress Syndrome; COVID-19 disease; Acute cardiac injury; Microangiopathy; Heart failure and cardiogenic shock; Stress cardiomyopathy; Coronary artery disease; Arrhythmia; Myocarditis, pericarditis; Thrombocytopenia; Deep vein thrombosis; Pulmonary embolus; Cerebrovascular stroke; Limb ischemia; Hemorrhagic disease; Acute kidney injury; Liver injury; Generalized convulsion; Guillain-Barré Syndrome; Acute disseminated encephalomyelitis; Anosmia, ageusia; Meningoencephalitis; Chilblain-like lesions; Single organ cutaneous vasculitis; Erythema multiforme; Serious local/systemic AR following immunization In particular, such the method of treatment may comprise the steps of:
a) providing at least one nucleic acid (e.g. DNA or RNA), preferably at least one RNA of the first aspect, at least one composition of the second aspect, at least one polypeptide of the third aspect, at least one vaccine of the fourth aspect, or the kit or kit of parts of the fifth aspect;
b) applying or administering said nucleic acid, composition, polypeptide, vaccine, or kit or kit of parts to a subject as a first dose
c) optionally, applying or administering said nucleic acid, composition, polypeptide, vaccine, or kit or kit of parts to a subject as a second dose or a further dose, preferably at least 3, 4, 5, 6, 7, 8, 9, 10, 11, 12, months after the first dose.

The first dosage, as used herein, refers to the initial/first dose, a second dose or any further doses, respectively, which are preferably administered in order to "boost" the immune reaction. In certain aspects, the vaccine/composition is administered to a subject one, two three, four or more times. In some aspects, the vaccine/composition is administered to the subject at least first and a second time (e.g., a prime and boost). In some aspects, the send administration is at least 10 days, 14 days, 21 days, 28 days, 35 days, 42 days, 49 days or 56 days after the first administration. In some aspects, the time between the first administration and the second administration is between about 7 days and about 56 days; about 14 days and about 56 days; about 21 days and about 56 days; or about 28 days and about 56 days. In further aspects, the vaccine/composition is administered to a subject three or more times. In certain aspects, there is at least 10 days, 14 days, 21 days, 28 days, 35 days, 42 days, 49 days or 56 days between each administration of the vaccine/composition.

In some aspects, a subject for treatment according to the embodiments was previously infected with SARS CoV-2 or was previously treated with at least a first SARS CoV-2 vaccine composition. In some aspects, the subject was treated with one, two, three or more doses of a first SARS CoV-2 vaccine composition. In some aspects, the composition of the embodiments used to treat a subject is a different type of vaccine composition than the composition previously used to treat the subject. In some aspects, the subject was previously treated with a mRNA vaccine, such as BNT162 or mRNA-1273. In further aspects, the subject was previously treated with a protein subunit vaccine, such as spike protein based vaccine, e.g., NVX-CoV2373 or COVAX. In certain preferred aspects, protein subunit vaccine compositions comprise an adjuvant. In further aspects, the subject was previously treated with a viral vector vaccine, such as an adenovirus vector based vaccine, e.g., ADZ1222 or Ad26.COV-2.S. In still further aspects, the subject was previously treated with an inactivated virus vaccine to SARS CoV-2 such as CoronaVac, BBIBP-CorV or BBV152. In further aspects, a subject previously treated with a vaccine composition has detectable SARS CoV-2 binding antibodies, such as SARS CoV-2 S protein-binding antibodies or SARS CoV-2 N protein-binding antibodies. In further aspects, a subject for treatment according the embodiments was treated with a first SARS CoV-2 vaccine composition at least about 3 month, 6 months, 9 months, 1 year, 1.5 years, 2 years or 3 years ago. In still further aspects, a subject for treatment according the embodiments was treated with a first SARS CoV-2 vaccine composition between about 3 months and 2 years ago or between about 6 months and 2 years ago. In some aspects, a subjects treated with a further vaccine composition of the embodiments are protected from moderate and severe COVID-19 disease in at least 80%, 85%, 90% or 95% of treated subjects. For example, the treated subjects can be protected from moderate and severe COVID-19 disease in at least 80%, 85%, 90% or 95% of treated subjects from about 2 weeks to about 1 year after administration of the further composition. In still further aspects, administering the further vaccine composition of the embodiments prevents moderate and severe COVID-19 disease in at least 80%, 85%, 90% or 95% of treated subjects from about 2 weeks to about 3 month, 6 months, 9 months, 1 year, 1.5 years, 2 years or 3 years after said administration. Examples of such combination vaccination strategies are shown below:

Dose 1 mRNA vaccine-T1-dose 2 mRNA vaccine-T2-dose 3 mRNA vaccine

Dose 1 mRNA vaccine-T1-dose 2 mRNA vaccine-T2-dose 3 protein subunit vaccine

Dose 1 mRNA vaccine-T1-dose 2 mRNA vaccine-T2-dose 3 viral vector vaccine

Dose 1 mRNA vaccine-T1-dose 2 mRNA vaccine-T2-dose 3 inactivated virus vaccine

Dose 1 protein subunit vaccine-T1-dose 2 protein subunit vaccine-T2-dose 3 mRNA vaccine Dose 1 inactivated virus vaccine-T1-dose 2 inactivated virus vaccine-T2-dose 3 mRNA vaccine Dose 1 viral vector vaccine-T1-dose 2 viral vector vaccine-T2-dose 3 mRNA vaccine Dose 1 viral vector vaccine-T2-dose 2 mRNA vaccine Dose 1 protein subunit vaccine-T2-dose 2 mRNA vaccine Dose 1 inactivated virus vaccine-T2-dose 2 mRNA vaccine Dose 1 mRNA vaccine-T2-dose 2 mRNA vaccine In the examples, above time period 1 (T1) is typically 2 to 6 weeks, preferably 3 to 4 weeks. Time period 2 (T2) is in some cases, about 3 months, 6 months, 9 months, 1 year, 1.5 years, 2 years or three years.

In some aspects, a method of the embodiments comprises administering multiple doses of a vaccine composition to a subject. In a further aspect, there is provided a method of reducing reactogenicity of a SARS CoV-2 booster vaccine composition. In some aspects, after an initial vaccination, subject exhibiting a high level of reactogenicity are administered a booster vaccine that is different from the initial vaccine composition. For example, in some aspects, the initial vaccine is BNT162 or mRNA-1273 and the booster vaccine is a mRNA vaccine composition of the embodiments. In some aspects, a booster vaccine composition for a subject with high reactogenicity is selected based having a lower concentration of PEG or PEG-conjugate compared to the previously administered vaccine composition. In some aspects, a booster vaccine composition for a subject with high reactogenicity is selected based on a lower concentration of mRNA or LNP compared to the previously administered vaccine composition.

In certain aspects, a subject for treatment according to the embodiments is administered a vaccine composition as booster vaccine and has previously been treated with one or more administrations of a coronavirus vaccine composition. In certain aspects, the subject being treated with a booster vaccine previously was treated with a vaccine composition that included a spike protein antigen or a nucleic acid molecule encoding a spike protein antigen. In some aspects, the subject selected for treatment with the booster vaccine was previously administered a vaccine composition comprising, or encoding, a spike protein having a different amino acid sequence than the spike protein of the booster vaccine. In certain aspects, the previously administered vaccine composition comprised, or encoded, a spike (e.g., a SARS CoV-2 spike) protein having at least 1, 2, 3, 4, 5, 6, 7, 8, 9, or 10 amino acid differences relative to the booster vaccine composition. In certain aspects, the booster vaccine composition comprises a RNA encoding a spike protein having about 1 to 50; about 3 to 30; about 5 to 30 or about 10 to 25 amino acid differences relative to the previously administered vaccine composition. In still further aspects, the booster vaccine composition comprises RNA encoding 2, 3, 4 or more distinct spike proteins with different amino acid sequences.

In further aspects, methods of the embodiments comprise administering 2 or more booster vaccine compositions to a subject, wherein each booster vaccine composition comprises RNA encoding a distinct spike protein with different amino acid sequences. In some aspects, such distinct booster vaccine compositions are administered essentially simultaneously or less than about 10 minutes, 20 minutes, 30 minutes, 1 hour or 2 hours apart. In some aspects, distinct booster vaccine compositions are administered to the same site, such as intramuscular injections to the same arm of the subject. In further aspects, distinct booster vaccine compositions are administered to different sites, such as intramuscular injections to different arms or to one or both arms and one more leg muscles.

In certain aspects, a method of the embodiments is further defined as a method of stimulating an antibody or CD8+ T-cell response in a subject. In some aspects, the method is defined as a method of stimulating a neutralizing antibody response in a subject. In further aspects, the method is defined as a method of stimulating a protective immune response in a subject. In yet further aspects, the method is defined as a method of stimulating TH2 directed immune response in a subject.

In further aspects, administration of a vaccine/composition/combination of the embodiments stimulates an antibody response that produces between about 10 and about 500 coronavirus spike protein-binding antibodies for every coronavirus neutralizing antibody in the subject. For example, the administration can stimulate an antibody response that produces no more than about 200 spike protein-binding antibodies for every coronavirus neutralizing antibody. In further aspects, the administration stimulates an antibody response that produces between about 10 and about 300; about 20 and about 300; about 20 and about 200; about 30 and about 100; or about 30 and about 80 coronavirus spike protein-binding antibodies for every coronavirus neutralizing antibody. In still further aspects, administration of composition of the embodiments stimulates an antibody response in a subject that includes a ratio of spike protein-binding antibodies to coronavirus neutralizing antibodies that is with 20%, 15%, 10% or 5% of the ratio of spike protein-binding antibodies to coronavirus neutralizing antibodies found in average convalescent patient serum (from a subject who has recovered from coronavirus infection).

In yet further aspects, administration of a vaccine/composition/combination of the embodiments stimulates an antibody response that produces between about 1 and about 500 coronavirus spike protein receptor binding domain (RBD)-binding antibodies for every coronavirus neutralizing antibody in the subject. In further aspects, the administration stimulates an antibody response that produces no more than about 50 spike protein RBD-binding antibodies for every coronavirus neutralizing antibody. In still further aspects, administration stimulates an antibody response that produces between about 1 and about 200; about 2 and about 100; about 3 and about 200; about 5 and about 100; about 5 and about 50; or about 5 and about 20 spike protein RBD-binding antibodies for every coronavirus neutralizing antibody. In still further aspects, administration of composition of the embodiments stimulates an antibody response in a subject that includes a ratio of spike protein RBD-binding antibodies to coronavirus neutralizing antibodies that is with 20%, 15%, 10% or 5% of the ratio of spike protein RBD-binding antibodies to coronavirus neutralizing antibodies found in average convalescent patient serum (from a subject who has recovered from coronavirus infection).

In still further aspects, administration of a vaccine/composition/combination of the embodiments induces essentially no increase in IL-4, IL-13, TNF and/or IL-1β in the subject. In further aspects, the administration of a vaccine/composition of the embodiments induces essentially no increase in serum IL-4, IL-13, TNF and/or IL-1β in the subject. In some aspects, the administration of a vaccine/composition of the embodiments induces essentially no increase in IL-4, IL-13, TNF and/or IL-1β at the injection site (e.g., an intramuscular injection site) in the subject.

In still further aspects, a method of the embodiments comprises administration of a vaccine/composition of the embodiments to a human subject having a disease. In certain aspects, the subject has cardiovascular disease, kidney disease, lung disease or an autoimmune disease. In some aspects, a vaccine/composition of the embodiments is administered to a subject who is receiving anti-coagulation therapy.

In still further aspects, administering a vaccine/composition/combination of the embodiments to human subjects results in no more than 20%, 15%, 10% 7.5% or 5% of the subjects experiencing a Grade 3 local adverse event (see Table A below). For example, in some aspects, no more than 10% of subjects experience a Grade 3 local adverse event after a first or a second dose of the composition. In preferred aspects, administering a composition of the embodiments to human subjects results in no more than 40%, 30%, 25%, 20%, 15%, 10%, 7.5% or 5% of the subjects experiencing a Grade 2 of higher local adverse event. For example, in some aspects, no more than 30% of subjects experience a Grade 2 or higher local adverse event after a first or a second dose of the composition. In some aspects, administering a composition of the embodiments to human subjects results in no more than 10% of the subjects experiencing Grade 3 pain, redness, swelling and/or itching at the injection site.

In further aspects, administering a vaccine/composition/combination of the embodiments to human subjects results in no more than 30%, 25%, 20%, 15%, 10% or 5% of the subjects experiencing a Grade 3 systemic adverse event (see Table B below). For example, in some aspects, no more than 25% of subjects experience a Grade 3 systemic adverse event after a first dose of the composition. In some aspects, no more than 40% of subjects experience a Grade 3 systemic adverse event after a second dose of the composition. In some aspects, administering a composition of the embodiments to human subjects results in no more than 30%, 25%, 20%, 15%, 10% or 5% of the subjects experiencing Grade 3 fever, headache, fatigue, chills, myalgia, arthralgia, nausea and/or diarrhea.

TABLE A

Intensity Grading* for Solicited Local Adverse Events

| AE | Grade | Definition |
| --- | --- | --- |
| Pain at Injection Site | 0 | Absent |
| | 1 | Does not interfere with activity |
| | 2 | Interferes with activity and/or repeated use of non-narcotic pain reliever > 24 hours |
| | 3 | Prevents daily activity and/or repeated use of narcotic pain reliever |
| Redness | 0 | <2.5 cm |
| | 1 | 2.5-5 cm |
| | 2 | 5.1-10 cm |
| | 3 | >10 cm |
| Swelling | 0 | <2.5 cm |
| | 1 | 2.5-5 cm and does not interfere with activity |
| | 2 | 5.1-10 cm or interferes with activity |
| | 3 | >10 cm or prevents daily activity |
| Itching | 0 | Absent |
| | 1 | Mild, no interference with normal activity |
| | 2 | Moderate, some interference with normal activity |
| | 3 | Significant, prevents normal activity |

TABLE B

Intensity Grading* for Solicited Systemic Adverse Events

| Adverse Event | Grade | Definition |
| --- | --- | --- |
| Fever | 0 | <38° C. |
| | 1 | ≥38.0-38.4° C. |
| | 2 | ≥38.5-38.9° C. |
| | 3 | ≥39° C. |
| Headache | 0 | Absent |
| | 1 | Mild, no interference with normal activity |
| | 2 | Moderate, some interference with normal activity and/or repeated use of non-narcotic pain reliever > 24 hours |
| | 3 | Significant; any use of narcotic pain reliever and/or prevents daily activity |
| Fatigue | 0 | Absent |
| | 1 | Mild, no interference with normal activity |
| | 2 | Moderate, some interference with normal activity |
| | 3 | Significant, prevents normal activity |
| Chills | 0 | Absent |
| | 1 | Mild, no interference with normal activity |
| | 2 | Moderate, some interference with normal activity |
| | 3 | Significant, prevents normal activity |
| Myalgia | 0 | Absent |
| | 1 | Mild, no interference with normal activity |
| | 2 | Moderate, some interference with normal activity |
| | 3 | Significant, prevents normal activity |

TABLE B-continued

Intensity Grading* for Solicited Systemic Adverse Events

| Adverse Event | Grade | Definition |
| --- | --- | --- |
| Arthralgia | 0 | Absent |
| | 1 | Mild, no interference with normal activity |
| | 2 | Moderate, some interference with normal activity |
| | 3 | Significant, prevents normal activity |
| Nausea/ Vomiting | 0 | Absent |
| | 1 | Mild, no interference with activity and/or 1-2 episodes/24 hours |
| | 2 | Moderate, some interference with activity and/or >2 episodes/24 hours |
| | 3 | Significant, prevents daily activity, requires outpatient IV hydration |
| Diarrhea | 0 | Absent |
| | 1 | 2-3 loose stools over 24 hours |
| | 2 | 4-5 stools over 24 hours |
| | 3 | 6 or more watery stools over 24 hours or requires outpatient IV hydration |

*FDA toxicity grading scale (US Department of Health and Human Services. Food and Drug Administration (FDA). Guidance for Industry. Toxicity Grading Scale for Healthy Adult and Adolescent Volunteers Enrolled in Preventive Vaccine Clinical Trials. 2007. On the world wide web at fda.gov/downloads/BiologicsBloodVaccines/GuidanceCompliance-RegulatoryInformation/Guidances/Vaccines/ucm09 1977.pdf; Accessed at: March 2019, incorporated herein by reference); IV = Intravenous.

According to a further aspect, the present invention also provides a method for expression of at least one polypeptide comprising at least one peptide or protein derived from a coronavirus, or a fragment or variant thereof, wherein the method preferably comprises the following steps:
 a) providing at least one nucleic acid of the first aspect or at least one composition of the second aspect; and
 b) applying or administering said nucleic acid or composition to an expression system (cells), a tissue, an organism. A suitable cell for expressing a polypeptide (that is provided by the nucleic acid of the invention) may be a *Drosophila* S2 insect cell line.

The method for expression may be applied for laboratory, for research, for diagnostic, for commercial production of peptides or proteins and/or for therapeutic purposes. The method may furthermore be carried out in the context of the treatment of a specific disease, particularly in the treatment of infectious diseases, particularly coronavirus infections, preferably SARS-CoV-2 coronavirus infections and the disease COVID-19.

Likewise, according to another aspect, the present invention also provides the use of the nucleic acid, the composition, the polypeptide, the vaccine, or the kit or kit of parts preferably for diagnostic or therapeutic purposes, e.g. for expression of an encoded coronavirus antigenic peptide or protein.

In specific embodiments, applying or administering said nucleic acid, polypeptide, composition, vaccine, combination to a tissue or an organism may be followed by e.g. a step of obtaining induced coronavirus antibodies e.g. SARS-CoV-2 coronavirus specific (monoclonal) antibodies or a step of obtaining generated SARS-CoV-2 coronavirus protein constructs (S protein).

The use may be applied for a (diagnostic) laboratory, for research, for diagnostics, for commercial production of peptides, proteins, or SARS-CoV-2 coronavirus antibodies and/or for therapeutic purposes. The use may be carried out in vitro, in vivo or ex vivo. The use may furthermore be carried out in the context of the treatment of a specific disease, particularly in the treatment of a coronavirus infection (e.g. COVID-19) or a related disorder.

According to a further aspect, the present invention also provides a method of manufacturing a composition or a vaccine, comprising the steps of:

a) RNA in vitro transcription step using a DNA template in the presence of a cap analogue to obtain capped mRNA, preferably having a nucleic acid sequence as provided in Table 3a and 3b;
b) Purifying the obtained capped RNA of step a) using RP-HPLC, and/or TFF, and/or Oligo(dT) purification and/or AEX, preferably using RP-HPLC;
c) Providing a first liquid composition comprising the purified capped RNA of step b);
d) Providing a second liquid composition comprising at least one cationic lipid as defined herein, a neutral lipid as defined herein, a steroid or steroid analogue as defined herein, and a PEG-lipid as defined herein;
e) Introducing the first liquid composition and the second liquid composition into at least one mixing means to allow the formation of LNPs comprising capped RNA;
f) Purifying the obtained LNPs comprising capped RNA;
g) optionally, lyophilizing the purified LNPs comprising capped RNA.

Preferably, the mixing means of step e) is a T-piece connector or a microfluidic mixing device. Preferably, the purifying step f) comprises at least one step selected from precipitation step, dialysis step, filtration step, TFF step. Optionally, an enzymatic polyadenylation step may be performed after step a) or b). Optionally, further purification steps may be implemented to e.g. remove residual DNA, buffers, small RNA by-products etc. Optionally, RNA in vitro transcription is performed in the absence of a cap analog, and an enzymatic capping step is performed after RNA vitro transcription. Optionally, RNA in vitro transcription is performed in the presence of at least one modified nucleotide as defined herein.

In embodiments, step a, preferably steps a-c, more preferably all steps outlined above (a-g) are performed in an automated device for RNA in vitro transcription. Such a device may also be used to produce the composition or the vaccine (see aspects 2 and 3). Preferably, a device as described in WO2020/002598, in particular, a device as described in claims 1 to 59 and/or 68 to 76 of WO2020/002598 (and FIGS. 1-18) may suitably be used.

List of Preferred Embodiments/Items

In the following, particularly preferred embodiments (items 1-275) of the invention are provided.

Item list:

Item 1. A nucleic acid comprising at least one coding sequence encoding at least one antigenic peptide or protein that is from or is derived from a SARS-CoV-2 coronavirus, or an immunogenic fragment or immunogenic variant thereof, wherein the nucleic acid comprises at least one heterologous untranslated region (UTR).

Item 2. Nucleic acid of Item 1, wherein the nucleic acid is suitable for a vaccine.

Item 3. Nucleic acid of Item 1 or 2, wherein the at least one antigenic peptide or protein comprises or consists of at least one peptide or protein that is or is derived from a structural protein, an accessory protein, or a replicase protein, or an immunogenic fragment or immunogenic variant of any of these.

Item 4. Nucleic acid of Item 3, wherein the structural protein is or is derived from a spike protein (S), an envelope protein (E), a membrane protein (M) or a nucleocapsid protein (N), or an immunogenic fragment or immunogenic variant of any of these.

Item 5. Nucleic acid of any one of Items 1 to 4, wherein the at least one antigenic peptide or protein is or is derived from a spike protein (S), or an immunogenic fragment or immunogenic variant thereof.

Item 6. Nucleic acid of any of the preceding Items, wherein the at least one antigenic peptide or protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1-111, 274-11663, 13176-13510, 13521-14123, 22732-22758, 22917, 22923, 22929-22964, 26938, 26939 or an immunogenic fragment or immunogenic variant of any of these.

Item 7. Nucleic acid of any one of Items 4 to 6, wherein the spike protein (S) comprises or consists of spike protein fragment S1, or an immunogenic fragment or immunogenic variant thereof.

Item 8. Nucleic acid of any one of the preceding Items, wherein the at least one antigenic peptide or protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1-27, 29, 31-48, 58-111, 274-1345, 1480-1546, 1614-11663, 13377-13510, 13521-14123, 22732, 22737-22758, 22929-22964 or an immunogenic fragment or immunogenic variant of any of these.

Item 9. Nucleic acid of any one of the preceding Items, wherein the at least one antigenic peptide or protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 27, 1279-1345, 29, 1480-1546, 13243-13309, 22733-22736, 26938, 26939 or an immunogenic fragment or immunogenic variant of any of these.

Item 10. Nucleic acid of any one of Items 4 to 9, wherein the spike protein (S) comprises or consists of a spike protein fragment S1 or an immunogenic fragment or immunogenic variant thereof, and spike protein fragment S2 or an immunogenic fragment or immunogenic variant thereof.

Item 11. Nucleic acid of any one of the preceding Items, wherein the at least one antigenic peptide or protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1-26, 31-48, 58-111, 274-1278, 1614-11663, 13377-13510, 13521-14177, 22732, 22737-22758, 22929-22964 or an immunogenic fragment or immunogenic variant of any of these.

Item 12. Nucleic acid of any one of Items 4 to 11, wherein the spike protein (S) is a pre-fusion stabilized spike protein (S_stab) comprising at least one pre-fusion stabilizing mutation.

Item 13. Nucleic acid of Item 12, wherein the at least one pre-fusion stabilizing mutation comprises the following amino acid substitutions: K986P and V987P.

Item 14. Nucleic acid of Item 12 or 13, wherein the at least one pre-fusion stabilizing mutation comprises a cavity filling mutation.

Item 15. Nucleic acid of Item 14, wherein the at least one cavity filling mutation is selected from the list comprising T887W; A1020W; T887W and A1020W; or P1069F.

Item 16. Nucleic acid of any one of Items 12 to 15, wherein the at least one pre-fusion stabilizing mutation comprises a mutated protonation site.

Item 17. Nucleic acid of Item 16, wherein the at least one mutated protonation site is selected from the list comprising H1048Q and H1064N; H1083N and H1101N; or H1048Q and H1064N and H1083N and H1101N.

Item 18. Nucleic acid of any one of Items 12 to 17, wherein the at least one pre-fusion stabilizing mutation generates at least one artificial intramolecular disulfide bond.

Item 19. Nucleic acid of Item 18, wherein the at least one artificial intramolecular disulfide bond is generated by the following amino acid substitutions: I712C and T1077C; I714C and Y1110C; P715C and P1069C; G889C and L1034C; I909C and Y1047C; Q965C and S1003C; F970C and G999C; A972C and R995C; A890C and V1040C; T874C and S1055C, or N914C and S1123C.

Item 20. Nucleic acid of any one of the preceding Items, wherein the at least one antigenic peptide or protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10-26, 40-48, 85-111, 341-1278, 1681-2618, 2686-3623, 3691-4628, 4696-5633, 5701-6638, 6706-7643, 7711-8648, 8716-9653, 9721-10658, 10726-11663, 13377-13510, 13521-14123, 22732, 22738, 22740, 22742, 22744, 22746, 22748, 22750, 22752, 22754, 22756, 22758, 22947-22964 or an immunogenic fragment or immunogenic variant of any of these.

Item 21. Nucleic acid of any one of the preceding Items, wherein the at least one antigenic peptide or protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10-26, 341-407, 609-1278, 13521-13587, 22738, 22740, 22742, 22744, 22746, 22748, 22750, 22752, 22754, 22756, 22758, 22947-22964 or an immunogenic fragment or immunogenic variant of any of these.

Item 22. Nucleic acid of any one of the preceding Items, wherein the at least one coding sequence additionally encodes one or more heterologous peptide or protein elements selected from a signal peptide, a linker, a helper epitope, an antigen clustering element, a trimerization element, a transmembrane element, and/or a VLP-forming sequence.

Item 23. Nucleic acid of Item 22, wherein the at least one heterologous peptide or protein element is a heterologous antigen-clustering element, a heterologous trimerization element, and/or a VLP-forming sequence.

Item 24. Nucleic acid of Item 22 or 23, wherein the at least one heterologous antigen clustering element is selected from a ferritin element, a lumazine synthase element, a surface antigen of Hepatitis B virus (HBsAg), or encapsulin.

Item 25. Nucleic acid of any one of the preceding Items, wherein the at least one antigenic peptide or protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 58-75, 85-102, 3624-5633, 7644-9653, 13588-13721, 13856-13989, 22733, 22735, 22736 or an immunogenic fragment or immunogenic variant of any of these.

Item 26. Nucleic acid of Item 22 or 23, wherein the at least one heterologous trimerization element is a foldon element, preferably a fibritin foldon element.

Item 27. Nucleic acid of any one of the preceding Items, wherein the at least one antigenic peptide or protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 76-84, 103-111, 5634-6638, 9654-10658, 13722-13788, 13990-14056, 22734, 26938, 26939 or an immunogenic fragment or immunogenic variant of any of these.

Item 28. Nucleic acid of Item 22 or 23, wherein the at least one VLP-forming sequence is a Woodchuck hepatitis core antigen element (WhcAg).

Item 29. Nucleic acid of any one of the preceding Items, wherein the at least one antigenic peptide or protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 6639-7643, 10659-11663, 13789-13855, 14057-14123 or an immunogenic fragment or immunogenic variant of any of these.

Item 30. Nucleic acid of any one of the preceding Items, wherein the at least one antigenic peptide or protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1, 10, 21, 22, 25, 27, 274, 341, 408, 475, 542, 743, 810, 1011, 1145, 1212, 1279, 8716, 10726, 22732-22758, 22929-22942, 22947-22964 or an immunogenic fragment or immunogenic variant of any of these.

Item 31. Nucleic acid of any one of the preceding Items, wherein the at least one antigenic peptide or protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10, 22960, 22961 or 22963 or an immunogenic fragment or immunogenic variant of any of these.

Item 32. Nucleic acid of any one of the preceding Items, wherein the at least one coding sequence comprises or consists of at least one nucleic acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 116-132, 134-138, 140-143, 145-175, 11664-11813, 11815, 11817-12050, 12052, 12054-13147, 13514, 13515, 13519, 13520, 14124-14177, 22759, 22764-22786, 22791-22813, 22818-22839, 22969-23184, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937 or a fragment or variant of any of these sequences.

Item 33. Nucleic acid of any one of the preceding Items, wherein the at least one antigenic peptide or protein is an S protein comprising a pre-fusion stabilizing K986P and V987P mutation comprising or consisting of the amino acid sequence being identical to SEQ ID NO: 10, or an immunogenic fragment or immunogenic variant of any of these.

Item 34. Nucleic acid of any one of the preceding Items, wherein the at least one coding sequence is a codon modified coding sequence, wherein the amino acid sequence encoded by the at least one codon modified coding sequence is preferably not being modified compared to the amino acid sequence encoded by the corresponding wild type or reference coding sequence.

Item 35. Nucleic acid of Item 34, wherein the at least one codon modified coding sequence is selected from C maximized coding sequence, CAI maximized coding sequence, human codon usage adapted coding sequence, G/C content modified coding sequence, and G/C optimized coding sequence, or any combination thereof.

Item 36. Nucleic acid of Item 34 or 35, wherein the at least one codon modified coding sequence is a G/C optimized coding sequence, a human codon usage adapted coding sequence, or a G/C content modified coding sequence.

Item 37. Nucleic acid of any one of the preceding Items, wherein the at least one coding sequence comprises or consists of a G/C optimized coding sequence comprising a nucleic acid sequence being identical or at least 70%, 80%, 85%, 86%, 87%, 88%, 89%, 90%, 91%, 92%, 93%, 94%, 95%, 96%, 97%, 98%, or 99% identical to any one SEQ ID NOs: 136-138, 140, 141, 148, 149, 152, 155, 156, 159, 162, 163, 166, 169, 170, 173, 11731-11813, 11815, 11817-11966, 12271-12472, 12743-12944, 13514, 13515, 14124-14132, 14142-14150, 14160-14168, 22759, 22764-22786, 22791-22813, 22818-22839, 22969-23040, 23077-23148, 23189-23260, 23297-23368, 23409-23480, 23517-23588, 23629-23700, 23737-23808, 23849-23920, 23957-24028, 24069-24140, 24177-24248, 24289-24360, 24397-24468, 24509-24580, 24617-24688, 24729-24800, 24837-24908, 24949-25020, 25057-25128, 25169-25240, 25277-25348, 25389-25460, 25497-25568, 25609-25680, 25717-25788, 25829-25900, 25937-26008, 26049-26120, 26157-26228, 26269-26340, 26377-26448, 26489-26560, 26597-26668, 26709-26780, 26817-26888, 26925-26937 or a fragment or variant of any of these sequences.

Item 38. Nucleic acid of any one of the preceding Items, wherein the at least one coding sequence comprises or consists of a human codon usage adapted coding sequence comprising a nucleic acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 142, 143, 145, 150, 153, 157, 160, 164, 167, 171, 174, 11967-12033, 12473-12539, 12945-13011 or a fragment or variant of any of these sequences.

Item 39. Nucleic acid of any one of the preceding Items, wherein the at least one coding sequence comprises or consists of a G/C content modified coding sequence comprising a nucleic acid sequence being identical or at least 70%, 80%, 85%, 86%, 87%, 88%, 89%, 90%, 91%, 92%, 93%, 94%, 95%, 96%, 97%, 98%, or 99% identical to any one SEQ ID NOs: 146, 147, 151, 154, 158, 161, 165, 168, 172, 175, 12034-12050, 12052, 12054-12203, 12540-12675, 13012-13147, 13519, 13520, 14133-14141, 14151-14159, 14169-14177, 23041-23076, 23149-23184, 23261-23296, 23369-23404, 23481-23516, 23589-23624, 23701-23736, 23809-23844, 23921-23956, 24029-24064, 24141-24176, 24249-24284, 24361-24396, 24469-24504, 24581-24616, 24689-24724, 24801-24836, 24909-24944, 25021-25056, 25129-25164, 25241-25276, 25349-25384, 25461-25496, 25569-25604, 25681-25716, 25789-25824, 25901-25936, 26009-26044, 26121-26156, 26229-26264, 26341-26376, 26449-26484, 26561-26596, 26669-26704, 26781-26816, 26889-26924 or a fragment or variant of any of these sequences.

Item 40. Nucleic acid of any one of the preceding Items, wherein the at least one coding sequence has a G/C content of at least about 50%, 55%, or 60%, preferably of about 63.9%.

Item 41. Nucleic acid of any one of the preceding Items, wherein the at least one coding sequence encodes an S protein comprising a pre-fusion stabilizing K986P and V987P mutation, wherein the coding sequence comprises or consists of a G/C optimized coding sequence comprising a nucleic acid sequence being identical to SEQ ID NOs: 137, 23090, 23091, 23093, 23094 or a fragment or variant thereof.

Item 42. Nucleic acid of any one of the preceding Items, wherein the at least one heterologous untranslated region is selected from at least one heterologous 5'-UTR and/or at least one heterologous 3'-UTR.

Item 43. Nucleic acid of Item 42, wherein the at least one heterologous 3'-UTR comprises or consists of a nucleic acid sequence derived from a 3'-UTR of a gene selected from PSMB3, ALB7, alpha-globin, CASP1, COX6B1, GNAS, NDUFA1 and RPS9, or from a homolog, a fragment or a variant of any one of these genes.

Item 44. Nucleic acid of Item 42, wherein the at least one heterologous 5'-UTR comprises or consists of a nucleic acid sequence derived from a 5'-UTR of a gene selected from HSD17B4, RPL32, ASAH1, ATP5A1, MP68, NDUFA4, NOSIP, RPL31, SLC7A3, TUBB4B and UBQLN2, or from a homolog, a fragment or variant of any one of these genes.

Item 45. Nucleic acid of Item 42, wherein the at least one heterologous 5'-UTR and the at least one heterologous 3' UTR is selected from UTR design a-1 (HSD17B4/PSMB3), a-3 (SLC7A3/PSMB3), e-2 (RPL31/RPS9), and i-3 (−/muag), wherein UTR design a-1 (HSD17B4/PSMB3) and i-3 (−/muag) are particularly preferred.

Item 46. Nucleic acid of any one of the preceding Items, wherein the nucleic acid comprises at least one poly(A) sequence, preferably comprising 30 to 200 adenosine nucleotides and/or at least one poly(C) sequence, preferably comprising 10 to 40 cytosine nucleotides.

Item 47. Nucleic acid of any one of the preceding Items, wherein the nucleic acid comprises at least one histone stem-loop.

Item 48. Nucleic acid of any one of the preceding Items, wherein the nucleic acid is a DNA or an RNA.

Item 49. Nucleic acid of any one of the preceding Items, wherein the nucleic acid is a coding RNA.

Item 50. Nucleic acid of Item 49, wherein the coding RNA is an mRNA, a self-replicating RNA, a circular RNA, or a replicon RNA.

Item 51. Nucleic acid of any one of the preceding Items, wherein the nucleic acid, preferably the coding RNA, is an mRNA.

Item 52. Nucleic acid of Item 51, wherein the mRNA is not a replicon RNA or a self-replicating RNA.

Item 53. Nucleic acid of Item 51, wherein the mRNA comprises at least one poly(A) sequence comprising 30 to 200 adenosine nucleotides and the 3' terminal nucleotide is an adenosine.

Item 54. Nucleic acid of any one of Items 48 to 51, wherein the RNA, preferably the coding RNA, comprises a 5'-cap structure, preferably m7G, cap0, cap1, cap2, a modified cap0 or a modified cap1 structure, preferably a 5'-cap1 structure.

Item 55. Nucleic acid of any one of Items 48 to 54, wherein the nucleic acid, preferably the mRNA, comprises the following elements in 5'- to 3'-direction:
A) 5'-cap1 structure;
B) coding sequence according to SEQ ID NO. 137, or a fragment or variant thereof;
C) 3'-UTR derived from a 3'-UTR of an alpha-globin gene, preferably according to SEQ ID NO: 267 or 268;
D) poly(A) sequence comprising about 64 A nucleotides;
E) poly(C) sequence comprising about 30 C nucleotides;
F) histone stem-loop according to SEQ ID NOs: 178 or 179.

Item 56. Nucleic acid of any one of Items 48 to 54, wherein the nucleic acid, preferably the mRNA, comprises the following elements in 5'- to 3'-direction:
  A) 5'-cap1 structure;
  B) 5'-UTR derived from a 5'-UTR of a HSD17B4 gene, preferably according to SEQ ID NO: 231 or 232;
  C) coding sequence according to SEQ ID NO. 137, or a fragment or variant thereof;
  D) 3'-UTR derived from a 3'-UTR of a PSMB3 gene, preferably according to SEQ ID NO: 253 or 254;
  E) a histone stem-loop selected from SEQ ID NOs: 178 or 179;
  F) poly(A) sequence comprising about 100 A nucleotides.
Item 57. Nucleic acid of Item 56, wherein the 3' terminal nucleotide is an adenosine.
Item 58. Nucleic acid of any one of Items 48 to 54, wherein the nucleic acid, preferably the mRNA, comprises the following elements in 5'- to 3'-direction:
  A) 5'-cap1 structure;
  B) coding sequence according to SEQ ID NO. 23090 or 23091, or a fragment or variant thereof;
  C) 3'-UTR derived from a 3'-UTR of an alpha-globin gene, preferably according to SEQ ID NO: 267 or 268;
  D) poly(A) sequence comprising about 64 A nucleotides;
  E) poly(C) sequence comprising about 30 C nucleotides;
  F) histone stem-loop according to SEQ ID NOs: 178 or 179.
Item 59. Nucleic acid of any one of Items 48 to 54, wherein the nucleic acid, preferably the mRNA, comprises the following elements in 5'- to 3'-direction:
  A) 5'-cap1 structure;
  B) 5'-UTR derived from a 5'-UTR of a HSD17B4 gene, preferably according to SEQ ID NO: 231 or 232;
  C) coding sequence according to SEQ ID NO. 23090 or 23091, or a fragment or variant thereof;
  D) 3'-UTR derived from a 3'-UTR of a PSMB3 gene, preferably according to SEQ ID NO: 253 or 254;
  E) a histone stem-loop selected from SEQ ID NOs: 178 or 179;
  F) poly(A) sequence comprising about 100 A nucleotides.
Item 60. Nucleic acid of any one of the preceding Items, wherein the nucleic acid comprises or consists of a nucleic acid sequence, preferably an RNA sequence, which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 148-175, 12204-13147, 14142-14177, 22786-22839, 23189-23404, 23409-23624, 23629-23844, 23849-24064, 24069-24284, 24289-24504, 24509-24724, 24729-24944, 24949-25164, 25169-25384, 25389-25604, 25609-25824, 25829-26044, 26049-26264, 26269-26484, 26489-26704, 26709-26937148 or a fragment or variant of any of these sequences.
Item 61. Nucleic acid of any one of the preceding Items, wherein the nucleic acid comprises or consists of a nucleic acid sequence, preferably an RNA sequence, which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 149, 156, 12338, 150, 157, 151, 158, 12541, 163, 170, 12810, 164, 171, 165, 172, 13013, 12342-12351, 12545-12554, 12814-12823, 13017-13026, 14133 or a fragment or variant of any of these sequences, preferably selected from SEQ ID NOs: 149, 150, 151, 163, 164, 165 or a fragment or variant of any of these sequences.
Item 62. Nucleic acid of any one of the preceding Items, wherein the nucleic acid comprises or consists of a nucleic acid sequence, preferably an RNA sequence, which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 163 or a fragment or variant thereof.
Item 63. Nucleic acid of any one of the preceding Items, wherein the nucleic acid comprises or consists of a nucleic acid sequence, preferably an RNA sequence, which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 149 or a fragment or variant thereof.
Item 64. Nucleic acid of any one of the preceding Items, wherein the nucleic acid comprises or consists of a nucleic acid sequence, preferably an RNA sequence, which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from SEQ ID NOs: 24837 or a fragment or variant thereof.
Item 65. Nucleic acid of any one of the preceding Items, wherein the nucleic acid comprises or consists of a nucleic acid sequence, preferably an RNA sequence, which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 23311, 23531, 24851 or a fragment or variant thereof.
Item 66. Nucleic acid of any one of the preceding Items, wherein the nucleic acid comprises or consists of a nucleic acid sequence, preferably an RNA sequence, which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 23310, 23530, 24850 or a fragment or variant thereof.
Item 67. Nucleic acid of any one of the preceding Items, wherein the nucleic acid comprises or consists of a nucleic acid sequence, preferably an RNA sequence, which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 23313, 23533, 24853, 23314, 23534, 24854 or a fragment or variant thereof.
Item 68. Nucleic acid of any one of the preceding Items, wherein the nucleic acid is an RNA that does not comprise a 1-methylpseudouridine substitution.
Item 69. Nucleic acid of any one of the preceding Items, wherein the nucleic acid is an RNA that does not comprise chemically modified nucleotides.
Item 70. Nucleic acid of any one of the preceding Items, wherein the nucleic acid is an in vitro transcribed RNA, wherein RNA in vitro transcription has been performed in the presence of a sequence optimized nucleotide mixture and a cap analog, preferably wherein the sequence optimized nucleotide mixture does not comprise chemically modified nucleotides.
Item 71. Nucleic acid of any one of the preceding Items, wherein the nucleic acid is a purified RNA, preferably an RNA that has been purified by RP-HPLC and/or TFF.
Item 72. Nucleic acid of any one of the preceding Items, wherein the nucleic acid is a purified RNA that has been purified by RP-HPLC and/or TFF and comprises about 5%, 10%, or 20% less double stranded RNA side products as an RNA that has not been purified with RP-HPLC and/or TFF.

Item 73. Nucleic acid of any one of the preceding Items, wherein the nucleic acid is a purified RNA that has been purified by RP-HPLC and/or TFF and comprises about 5%, 10%, or 20% less double stranded RNA side products as an RNA that has been purified with Oligo dT purification, precipitation, filtration and/or anion exchange chromatography.

Item 74. A composition comprising at least one nucleic acid as defined in any one of Items 1 to 73, wherein the composition optionally comprises at least one pharmaceutically acceptable carrier.

Item 75. Composition of Items 74, wherein the composition comprises an mRNA according to SEQ ID NOs: 149, 163, 24837, 23311, 23531, 23310, 23530, 23313 or 23533 or a fragment or variant of any of these sequences.

Item 76. Composition of Item 74, wherein the composition is a multivalent composition comprising a plurality or at least more than one of the nucleic acid as defined in in any one of Items 1 to 73.

Item 77. Composition of Item 76, wherein the plurality or at least more than one of the nucleic acid sequences of the multivalent composition each encode a different spike protein, preferably a prefusion stabilized spike protein.

Item 78. Composition of Item 77, wherein the different spike proteins or prefusion stabilized spike proteins are derived from different SARS-CoV-2 virus variants/isolates Item 79. Composition of Item 78, wherein the different spike proteins or prefusion stabilized spike proteins are derived from at least B.1.1.7, B.1.351, P.1, or CAL.20C.

Item 80. Composition of Item 78, wherein the different spike proteins or prefusion stabilized spike proteins have amino acid changes in the S protein comprising:
  (i) delH69, delV70, Y453F, D614G, I692V and M1229I;
  (ii) delH69, delV70, delY144, N501Y, A570D, D614G, P681H, T716I, S982A and D1118H;
  (iii) L18F, D80A, D215G, delL242, delA243, delL244, R246I, K417N, E484K, N501Y, D614G and A701V;
  (iv) L18F, T20N, P26S, D138Y, R190S, K417T, E484K, N501Y, D614G, H655Y and T1027I; and/or
  (v) S13I, W152C, L452R, and D614G.

Item 81. Composition of any one of Items 76 to 78, wherein the multivalent composition comprises at least two nucleic acid species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 10, 22961; 22960, 22963, 22941, 22964.

Item 82. Composition of any one of Items 76 to 78, wherein the multivalent composition comprises at least two RNA species being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 149 or 24837, 23531 or 24851, 23530 or 24850, 23533 or 24853, 23439 or 24759 or 23534 or 24854.

Item 83. Composition of any one of Items 74 to 80, wherein the composition comprises mRNA with an RNA integrity of 70% or more.

Item 84. Composition of any one of Items 74 to 83, wherein the composition comprises mRNA with a capping degree of 70% or more, preferably wherein at least 70%, 80%, or 90% of the mRNA species comprise a Cap1 structure.

Item 85. Composition of any one of Items 74 to 84, wherein the at least one nucleic acid is complexed or associated with or at least partially complexed or partially associated with one or more cationic or polycationic compound, preferably cationic or polycationic polymer, cationic or polycationic polysaccharide, cationic or polycationic lipid, cationic or polycationic protein, cationic or polycationic peptide, or any combinations thereof.

Item 86. Composition of Item 85, wherein the at least one nucleic acid is complexed or associated with one or more lipids or lipid-based carriers, thereby forming liposomes, lipid nanoparticles (LNP), lipoplexes, and/or nanoliposomes, preferably encapsulating the at least one nucleic acid.

Item 87. Composition of Items 85 or 86, wherein the at least one nucleic acid is complexed with one or more lipids thereby forming lipid nanoparticles.

Item 88. Composition of Item 86 or 87, wherein the LNP comprises a cationic lipid according to formula III-3:

Item 89. Composition of any one of Items 86-88, wherein the LNP comprises a PEG lipid of formula (IVa):

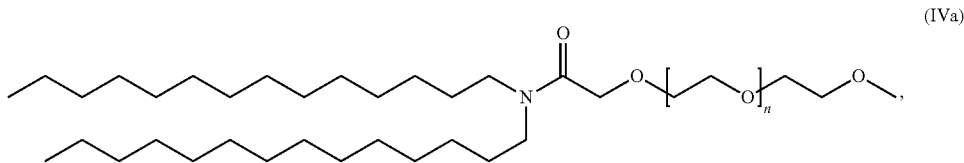

(IVa)

wherein n has a mean value ranging from 30 to 60, preferably wherein n has a mean value of about 45, 46, 47, 48, 49, 50, 51, 52, 53, 54, most preferably wherein n has a mean value of 49 or 45.

Item 90. Composition of any one of Items 86-88, wherein the LNP comprises a PEG lipid of formula (IVa):

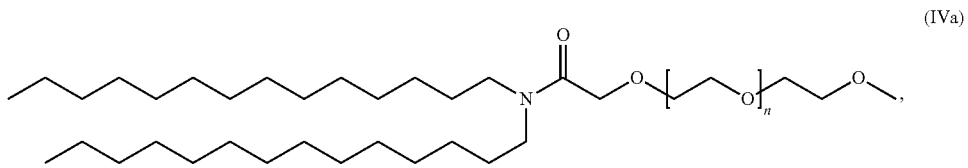

(IVa)

wherein n is an integer selected such that the average molecular weight of the PEG lipid is about 2500 g/mol.

Item 91. Composition of any one of Items 86-90, wherein the LNP comprises one or more neutral lipids and/or one or more steroid or steroid analogues.

Item 92. Composition of Item 91, wherein the neutral lipid is 1,2-distearoyl-sn-glycero-3-phosphocholine (DSPC), preferably wherein the molar ratio of the cationic lipid to DSPC is in the range from about 2:1 to about 8:1.

Item 93. Composition of Item 91, wherein the steroid is cholesterol, preferably wherein the molar ratio of the cationic lipid to cholesterol is in the range from about 2:1 to about 1:1.

Item 94. Composition of any one of Items 86-93, wherein the LNP comprises
(i) at least one cationic lipid, preferably a lipid of formula (III), more preferably lipid III-3;
(ii) at least one neutral lipid, preferably 1,2-distearoyl-sn-glycero-3-phosphocholine (DSPC);
(iii) at least one steroid or steroid analogue, preferably cholesterol; and
(iv) at least one polymer conjugated lipid, preferably a PEG-lipid derived from formula (IVa, with n=49),
wherein (i) to (iv) are in a molar ratio of about 20-60% cationic lipid, 5-25% neutral lipid, 25-55% sterol, and 0.5-15% PEG-lipid.

Item 95. Composition of any one of Items 86-93, wherein the LNP comprises
(i) at least one cationic lipid, preferably a lipid of formula (III), more preferably lipid III-3;
(ii) at least one neutral lipid, preferably 1,2-distearoyl-sn-glycero-3-phosphocholine (DSPC);
(iii) at least one steroid or steroid analogue, preferably cholesterol; and
(iv) at least one polymer conjugated lipid, preferably a PEG-lipid derived from formula (IVa, with n=45),
wherein (i) to (iv) are in a molar ratio of about 20-60% cationic lipid, 5-25% neutral lipid, 25-55% sterol, and 0.5-15% PEG-lipid.

Item 96. Composition of Item 94 or 95, wherein (i) to (iv) are in a molar ratio of about 50:10:38.5:1.5, preferably 47.5:10:40.8:1.7 or more preferably 47.4:10:40.9:1.7.

Item 97. Composition of any one of Items 87 to 96, wherein the nucleic acid is RNA and the composition comprises less than about 20% free (non complexed or non-encapsulated) RNA, preferably less than about 15% free RNA, more preferably less than about 10% free RNA.

Item 98. Composition of any one of Items 87 to 97, wherein the wt/wt ratio of lipid to nucleic acid is from about 10:1 to about 60:1, preferably from about 20:1 to about 30:1, for example about 25:1.

Item 99. Composition of any one of Items 87 to 98, wherein the n/p ratio of the LNPs encapsulating the nucleic acid is in a range from about 1 to about 10, preferably in a range from about 5 to about 7, more preferably about 6.

Item 100. Composition of any one of Items 87 to 99, wherein the composition has a polydispersity index (PDI) value of less than about 0.4, preferably of less than about 0.3, more preferably of less than about 0.2, most preferably of less than about 0.1.

Item 101. Composition of any one of Items 86 to 100, wherein the LNPs have a Z-average size in a range of about 60 nm to about 120 nm, preferably less than about 120 nm, more preferably less than about 100 nm, most preferably less than about 80 nm.

Item 102. Composition of any one of Items 86 to 101, wherein the LNPs comprise less than about 10%, 9%, 8%, 7%, 6%, 5%, 4%, 3%, 2%, 1% LNPs that have a particle size exceeding about 500 nm.

Item 103. Composition of any one of Items 86 to 102, wherein the LNPs comprise less than about 10%, 9%, 8%, 7%, 6%, 5%, 4%, 3%, 2%, 1% LNPs that have a particle size smaller than about 20 nm.

Item 104. Composition of any one of Items 86 to 103, wherein at least about 80%, 85%, 90%, 95% of lipid-based carriers have a spherical morphology, preferably comprising a solid core or partially solid core.

Item 105. Composition of any one of Items 86 to 104, wherein the composition has a turbidity ranging from about 150 FNU to about 0.0 FNU, preferably of about 50 FNU or less, more preferably of about 25 FNU or less.

Item 106. Composition of any one of Items 74 to 105, further comprising a sugar in a concentration of about 50 to about 300 mM, preferably sucrose in a concentration of about 150 mM.

Item 107. Composition of any one of Items 74 to 106, further comprising a salt in a concentration of about 10 mM to about 200 mM, preferably NaCl in a concentration of about 75 mM.

Item 108. Composition of any one of Items 74 to 107, further comprising a buffering agent in a concentration 1 mM to about 100 mM, preferably $Na_3PO_4$ in a concentration of about 10 mM.

Item 109. Composition of any one of Items 74 to 108, wherein the composition has a pH in a range of about pH 7.0 to about pH 8.0, preferably of about pH 7.4.

Item 110. Composition of any one of Items 86 to 109, comprising lipid nanoparticles encapsulating an RNA encoding a SARS-CoV-2 S protein comprising a pre-fusion stabilizing K986P and V987P mutation
wherein the LNPs comprise
  (i) cationic lipid of formula III-3;
  (ii) 1,2-distearoyl-sn-glycero-3-phosphocholine (DSPC);
  (iii) cholesterol; and
  (iv) PEG-lipid of formula IVa (n=49)),
wherein (i) to (iv) are in a molar ratio of about 47.4% cationic lipid, 10% DSPC, 40.9 cholesterol, 1.7% PEG-lipid;
wherein the RNA is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO. 163 or 149;
wherein the RNA is not chemically modified;
wherein the RNA comprises a 5'-Cap1 structure;
wherein the integrity of the RNA is at least about 70%;
wherein the n/p ratio of the LNPs encapsulating the RNA is about 6;
wherein the LNPs encapsulating the RNA have a Z-average size of about 60 nm to about 120 nm;
wherein the composition comprises less than about 20% free (non complexed; non-encapsulated) RNA; optionally, wherein the composition further comprises sucrose in a concentration of about 150 mM, NaCl in a concentration of about 75 mM, $Na_3PO_4$ in a concentration of about 10 mM;
optionally, wherein the composition has a pH of about pH 7.4.

Item 111. Composition of any one of Items 86 to 109, comprising lipid nanoparticles encapsulating an RNA encoding a SARS-CoV-2 S protein comprising a pre-fusion stabilizing K986P and V987P mutation
wherein the LNPs comprise
  (i) cationic lipid of formula III-3;
  (ii) 1,2-distearoyl-sn-glycero-3-phosphocholine (DSPC);
  (iii) cholesterol; and
  (iv) PEG-lipid of formula IVa (n=45)),
wherein (i) to (iv) are in a molar ratio of about 47.4% cationic lipid, 10% DSPC, 40.9 cholesterol, 1.7% PEG-lipid;
wherein the RNA is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO. 163 or 149;
wherein the RNA is not chemically modified;
wherein the RNA comprises a 5'-Cap1 structure;
wherein the integrity of the RNA is at least about 70%;
wherein the n/p ratio of the LNPs encapsulating the RNA is about 6;
wherein the LNPs encapsulating the RNA have a Z-average size of about 60 nm to about 120 nm; wherein the composition comprises less than about 20% free (non complexed) RNA;
optionally, wherein the composition further comprises sucrose in a concentration of about 150 mM, NaCl in a concentration of about 75 mM, $Na_3PO_4$ in a concentration of about 10 mM;
optionally, wherein the composition has a pH of about pH 7.4.

Item 112. Composition of any one of Items 86 to 110, comprising an RNA that is not chemically modified, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO. 163 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3, DSPC, cholesterol and PEG-lipid of formula (IVa).

Item 113. Composition of any one of Items 86 to 110, comprising an RNA that is not chemically modified, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO. 149 formulated in lipid nanoparticles (LNPs), which have a molar ratio of approximately 50:10:38.5:1.5, preferably 47.5:10:40.8:1.7 or more preferably 47.4:10:40.9:1.7 proportion (mol %) of cationic lipid III-3, DSPC, cholesterol and PEG-lipid of formula (IVa).

Item 114. Composition any one of Items 74 to 112, wherein the composition comprises a mRNA encoding a SARS-CoV-2 spike protein (S) that is a pre-fusion stabilized spike protein (S_stab) comprising at least one pre-fusion stabilizing mutation.

Item 115. Composition of Item 114, wherein the mRNA encodes a SARS-CoV-2 spike protein at least 95% identical to SEQ ID NO: 163 or encodes a coronavirus spike protein identical to SEQ ID NO: 163.

Item 116. Composition of Item 114, wherein the LNP comprises
  (i) at least one cationic lipid;
  (ii) at least one neutral lipid;
  (iii) at least one steroid or steroid analogue; and
  (iv) at least one PEG-lipid,
  wherein (i) to (iv) are in a molar ratio of about 20-60% cationic lipid, 5-25% neutral lipid, 25-55% sterol, and 0.5-15% PEG-lipid.

Item 117. Composition of Item 114, wherein the LNP comprises
  (i) at least one cationic lipid according to formula III-3;
  (ii) DSPC;
  (iii) cholesterol; and
  (iv) a PEG-lipid, according to formula IVa,
  wherein (i) to (iv) are in a molar ratio of about 20-60% cationic lipid, 5-25% neutral lipid, 25-55% sterol, and 0.5-15% PEG-lipid.

Item 118. Composition of Item 114, wherein the LNP comprises
(i) at least one cationic lipid according to formula III-3;
(ii) DSPC;
(iii) cholesterol; and
(iv) a PEG-lipid, according to formula IVa,
wherein (i) to (iv) are in a molar ratio of about 47.5:10:40.8:1.7.

Item 119. Composition of Item 114, wherein the LNP comprises:
(i) at least one cationic lipid according to formula III-3;
(ii) DSPC;
(iii) cholesterol; and
(iv) a PEG-lipid, according to formula IVa,
wherein (i) to (iv) are in a molar ratio of 47.4:10:40.9:1.7.

Item 120. Composition of anyone of Items 107-118, wherein the ratio of mRNA to total lipid is about 0.03-0.04 w/w.

Item 121. Composition of Item 120, wherein the mRNA is complexed with one or more lipids thereby forming lipid nanoparticles (LNP), wherein the LNP comprises
(i) at least one cationic lipid according to formula III-3;
(ii) DSPC;
(iii) cholesterol; and
(iv) a PEG-lipid, according to formula IVa,
wherein (i) to (iv) are in a molar ratio of about 47.5:10:40.8:1.7, and
wherein the ratio of mRNA to total lipid is about 0.03-0.04 w/w.

Item 122. Composition of Item 120, wherein the mRNA is complexed with one or more lipids thereby forming lipid nanoparticles (LNP), wherein the LNP comprises:
(i) at least one cationic lipid according to formula III-3;
(ii) DSPC;
(iii) cholesterol; and
(iv) a PEG-lipid, according to formula IVa,
wherein (i) to (iv) are in a molar ratio of 47.4:10:40.9:1.7, and
wherein the ratio of mRNA to total lipid is about 0.03-0.04 w/w.

Item 123. Composition of any one of Items 74-99 or 110-122, wherein the composition is a lyophilized composition.

Item 124. Composition of Item 123, wherein the lyophilized composition has a water content of less than about 10%.

Item 125. Composition of Item 124, wherein the lyophilized composition has a water content of between about 0.5% and 5%.

Item 126. Composition any one of Items 86 to 122, wherein the nucleic acid is RNA and wherein the composition is stable for at least about two weeks after storage as a liquid at temperatures of about 5° C.

Item 127. Composition of Item 126, wherein the nucleic acid is RNA and wherein the composition is stable for at least 1 month after storage as a liquid at temperatures of about 5° C.

Item 128. Composition of Item 126, wherein the nucleic acid is RNA and wherein the composition is stable for about 2 weeks to about 1 month, 2 months, 3 months, 4 months, 5 months, 6 months or 1 year after storage as a liquid at temperatures of about 5° C.

Item 129. Composition of Item 126, wherein the nucleic acid is RNA and wherein at least 70%, 75%, 80%, 85%, 90% or 95% of the RNA is intact at least about two weeks after storage as a liquid at temperatures of about 5° C.

Item 130. Composition of Item 129, wherein the nucleic acid is RNA and wherein at least 70%, 75%, 80%, 85%, 90% or 95% of the RNA is intact at least 1 month after storage as a liquid at temperatures of about 5° C.

Item 131. Composition of Item 126, wherein the nucleic acid is RNA and wherein at least 70%, 75%, 80%, 85%, 90% or 95% of the RNA is intact about 2 weeks to about 1 month, 2 months, 3 months, 4 months, 5 months, 6 months or 1 year after storage as a liquid at temperatures of about 5° C.

Item 132. Composition of Item 126, wherein the nucleic acid is RNA and wherein at least 80% of the RNA is intact after about two weeks of storage as a liquid at temperatures of about 5° C.

Item 133. Composition any one of Items 86 to 132, wherein the composition comprises an aggregation reducing lipid.

Item 134. Composition any one of Items 86 to 133, wherein the nucleic acid is RNA and wherein the concentration of the RNA is in a range from about 10 µg/ml to about 10 mg/ml, preferably in a range from about 100 µg/ml to about 1 mg/ml.

Item 135. Composition any one of Items 86 to 133, wherein the nucleic acid is RNA and wherein the concentration of the RNA is at least 100 µg/ml, more preferably at least 200 µg/ml, most preferably at least 500 µg/ml.

Item 136. Composition any one of Items 86 to 135, wherein the nucleic acid is RNA and wherein the RNA has an RNA integrity of at least about 50%, preferably of at least about 60%, more preferably of at least about 70%, most preferably of at least about 80%.

Item 137. Composition any one of Items 86 to 136, wherein the nucleic acid is RNA and wherein the composition comprises less than about 20% free RNA, preferably less than about 15% free RNA, more preferably less than about 10% free RNA.

Item 138. Composition any one of Items 86 to 137, wherein the nucleic acid is RNA and wherein the composition comprises less than about 100 nM divalent cations per g RNA, preferably less than about 50 nM divalent cations per g RNA, more preferably less than about 10 nM divalent cations per g RNA.

Item 139. Composition of Item 138, wherein the divalent cations are selected from Mg2+ and/or Ca2+.

Item 140. Composition of any one of Items 86 to 139, wherein the concentration of lipid is in a range from about 250 µg/ml to about 250 mg/ml, preferably in a range from about 2.5 mg/ml to about 25 mg/ml.

Item 141. Composition of any one of Items 86 to 140, wherein the concentration of lipid is at least about 2.5 mg/ml, preferably at least 5 mg/ml, more preferably at least 12.5 mg/ml.

Item 142. Composition of any one of Items 133 to 142, wherein the concentration of aggregation reducing lipid is in a range from about 17.5 µg/ml to about 17.5 mg/ml, preferably in a range from about 175 µg/ml to about 1.75 mg/ml.

Item 143. Composition of any one of Items 133 to 142, wherein the concentration of aggregation reducing lipid is at least about 175 µg/ml, preferably at least about 350 µg/ml, more preferably at least 875 µg/ml.

Item 144. Composition of any one of Items 86 to 143, wherein the nucleic acid is RNA and wherein the wt/wt ratio of lipid to the RNA is from about 10:1 to about 60:1, preferably from about 20:1 to about 30:1, more preferably about 25:1.

Item 145. Composition of any one of Items 86 to 144, wherein the nucleic acid is RNA and wherein the N/P ratio of the lipid-based carriers to the RNA is in a range from about 1 to about 10, preferably in a range from about 5 to about 7, more preferably about 6.

Item 146. Composition of any one of Item 86 to 143, wherein the nucleic acid is RNA and wherein the lipid-based carriers encapsulating the RNA comprise an aggregation reducing lipid in a molar ratio of about 0.5%-15%, preferably in a molar ratio of about 1.0% to about 2.5%, more preferably in a molar ratio of about 1.7%.

Item 147. Composition of any one of Item 133 to 143, wherein the aggregation reducing lipid is a polymer conjugated lipid, e.g. a PEG-conjugated lipid.

Item 148. Composition of any one of Item 86 to 147, wherein the nucleic acid is RNA and wherein the RNA and lipid-based carrier encapsulating the RNA have been purified by at least one purification step, preferably by at least one step of TFF and/or at least one step of clarification and/or at least one step of filtration.

Item 149. Composition of any one of Item 86 to 148, wherein the composition comprises less than about 500 ppM ethanol, preferably less than about 50 ppM ethanol, more preferably less than about 5 ppM ethanol.

Item 150. Composition of any one of Item 86 to 154, wherein the composition has an osmolarity of about 250 mOsmol/kg to about 450 mOsmol/kg, preferably of about 335 mOsmol/kg.

Item 151. Composition of any one of Item 86 to 150, wherein the composition is stable for at least 1 week, preferably for at least 2 weeks, more preferably for at least 3 weeks, most preferably for at least 4 weeks after storage as a liquid at about 25° C.

Item 152. Composition of any one of Item 86 to 151, wherein the composition is stable for at least 1 day, preferably for at least 2 days, more preferably for at least 3 days, most preferably for at least 4 days after storage as a liquid at about 40° C.

Item 153. Composition of any one of Item 86 to 152, wherein upon storage as a liquid, the integrity of the RNA decreases less than about 30%, preferably less than about 20%, more preferably less than about 10%.

Item 154. Composition of any one of Item 86 to 153, wherein upon storage as a liquid, the amount of free RNA does not increase by more than 10%, preferably by not more than 5%.

Item 155. Composition of any one of Item 86 to 154, wherein the nucleic acid is RNA and wherein upon storage as a liquid, the PDI value of the lipid-based carriers encapsulating the RNA does not increase by more than a value of about 0.2, preferably by not more than a value of about 0.1.

Item 156. Composition of any one of Item 86 to 155, wherein the nucleic acid is RNA and wherein upon storage as a liquid, the Z-average size of the lipid-based carriers encapsulating the RNA does not increase by more than 20%, preferably by not more than 10%.

Item 157. Composition of any one of Item 86 to 156, wherein upon storage as a liquid, the turbidity of the composition does not increase by more than 20%, preferably by not more than 10%.

Item 158. Composition of any one of Item 86 to 157, wherein upon storage as a liquid, the pH and/or the osmolality does not increase or decrease by more than 20%, preferably by not more than 10%.

Item 159. Composition of any one of Item 86 to 158, wherein upon storage as a liquid, the potency of the composition decreases less than about 30%, preferably less than about 20%, more preferably less than about 10%.

Item 160. Composition of any one of Items 86 to 133, wherein the nucleic acid is RNA and wherein the RNA is a purified RNA, preferably an RP-HPLC purified RNA and/or a tangential flow filtration (TFF) purified RNA.

Item 161. Composition of any one of Items 74 to 160, additionally comprising at least one antagonist of at least one RNA sensing pattern recognition receptor, preferably at least one antagonist of a TLR7 receptor and/or a TLR8 receptor.

Item 162. Composition of Item 161, wherein the at least one antagonist of a TLR7 receptor and/or a TLR8 receptor is a single stranded oligonucleotide, preferably p5'-GAG CGmG CCA-3'.

Item 163. A polypeptide for a vaccine comprising at least one antigenic peptide or protein that is or is derived from a coronavirus SARS-CoV-2, or an immunogenic fragment or immunogenic variant thereof, preferably wherein the amino acid sequences of said antigenic peptide or protein is identical or at least 70%, 80%, 85%, 86%, 87%, 88%, 89%, 90%, 91%, 92%, 93%, 94%, 95%, 96%, 97%, 98%, or 99% identical to any one of amino acid sequences SEQ ID NOs: 1-111, 274-11663, 13176-13510, 13521-14123, 22732-22758, 22917, 22923, 22929-22964, 26938, 26939, or an immunogenic fragment or immunogenic variant of any of these.

Item 164. A vaccine comprising the nucleic acid of any one of Items 1 to 73, and/or the composition of any one of Items 74 to 162, and/or the polypeptide of Item 163.

Item 165. A vaccine of Item 164, wherein the vaccine elicits an adaptive immune response, preferably a protective adaptive immune response against a coronavirus, preferably against coronavirus SARS-CoV-2.

Item 166. A vaccine of Item 164 or 165, wherein the vaccine is a multivalent vaccine comprising a plurality or at least more than one of the nucleic acid as defined in any one of Items 1 to 73, or a plurality or at least more than one of the compositions as defined in any one of Items 74 to 162.

Item 167. A Kit or kit of parts, comprising the nucleic acid of any one of Items 1 to 73, and/or the composition of any one of Items 74 to 162, and/or the polypeptide of Item 163, and/or the vaccine of Item 164 to 166, optionally comprising a liquid vehicle for solubilising, and, optionally, technical instructions providing information on administration and dosage of the components.

Item 168. Nucleic acid of any one of Items 1 to 73, the composition of any one of Items 74 to 162 the polypeptide of Item 163, the vaccine of Item 164 to 166, the kit or kit of parts of Item 167, for use as a medicament.

Item 169. Nucleic acid of any one of Items 1 to 73, the composition of any one of Items 74 to 162, the polypeptide of Item 163, the vaccine of Item 164 to 166, the kit or kit of parts of Item 167, for use in the treatment or prophylaxis of an infection with a coronavirus, preferably a SARS-CoV-2 coronavirus, or of a disorder related to such an infection, preferably COVID-19.

Item 170. A method of treating or preventing a disorder, wherein the method comprises applying or administering to a subject in need thereof the nucleic acid of any one of Items 1 to 73, the composition of any one of Items 74 to 162, the polypeptide of Item 163, the vaccine of Item 164 to 166, and/or the kit or kit of parts of Item 167.

Item 171. The method of treating or preventing a disorder of Item 170, wherein the disorder is an infection with a coronavirus, preferably a SARS-CoV-2 coronavirus, or a disorder related to such an infection, preferably COVID-19.

Item 172. The method of treating or preventing a disorder of Item 170 or 171, wherein the subject in need is a mammalian subject, preferably a human subject.

Item 173. The method of treating or preventing a disorder of any one of Items 170 to 172, wherein the human subject is an elderly human subject, preferably of an age of at least 50, 60, 65, or 70 years.

Item 174. The method of treating or preventing a disorder of Item 173, wherein the human subject is 61 years of age or older.

Item 175. The method of treating or preventing a disorder of any one of Items 170 to 172, wherein the human subject is 18 to 60 years of age.

Item 176. The method of treating or preventing a disorder of any one of Items 170 to 172, wherein the subject is pregnant.

Item 177. The method of any one of Items 170 to 175, wherein no more than 25% of subjects experience a Grade 3 systemic adverse event after a first dose of the composition or wherein no more than 30% of subjects experience a Grade 2 or higher local adverse event after a first dose of the composition.

Item 178. The method of any one of Items 170 to 175, wherein no more than 40% of subjects experience a Grade 3 systemic adverse event after a second dose of the composition.

Item 179. The method of treating or preventing a disorder of any one of Items 170 to 172, wherein the human subject is a newborn or infant, preferably of an age of not more than 3 years, of not more than 2 years, of not more than 1.5 years, of not more than 1 year (12 months), of not more than 9 months, 6 months or 3 months, or of an age between 6 months and 2 years Item 180. The method of Item 170, further defined as a method of reducing disease burden in the subject.

Item 181. The method of Item 180, wherein the method reduces the severity of one or more symptom of COVID-19 disease.

Item 182. The method of Item 181, wherein the method reduces the probability that the subject will require hospital admission, intensive care unit admission, treatment with supplemental oxygen and/or treatment with a ventilator.

Item 183. The method of Item 181, wherein the method reduces the probability that the subject will develop severe or moderate COVID-19 disease.

Item 184. The method of Item 181, wherein the method prevents severe COVID-19 disease in the subject for at least about 6 months.

Item 185. The method of Item 184, wherein the method prevents severe COVID-19 disease in the subject when the subject is exposed to a SARS CoV-2 variant having a least a first amino acid change in the S protein as compared to SEQ ID NO: 1.

Item 186. The method of Item 185, wherein the SARS CoV-2 variant has amino acid changes in the S protein comprising:
(i) delH69, delV70, Y453F, D614G, I692V and M1229I;
(ii) delH69, delV70, delY144, N501Y, A570D, D614G, P681H, T716I, S982A and D1118H;
(iii) L18F, D80A, D215G, delL242, delA243, delL244, R2461, K417N, E484K, N501Y, D614G and A701V;
(iv) L18F, T20N, P26S, D138Y, R190S, K417T, E484K, N501Y, D614G, H655Y and T10271; and/or
(v) S13I, W152C, L452R, and D614G.

Item 187. The method of Item 181, wherein the method reduces the probability that the subject will develop a fever, breathing difficulties; loss of smell and/or loss of taste.

Item 188. The method of Item 181, wherein the method reduces the probability that the subject will develop a fever, breathing difficulties; loss of smell and/or loss of taste.

Item 189. The method of Item 170, wherein the subject has a disease or is immune compromised.

Item 190. The method of Item 189, wherein the subject has liver disease, kidney disease diabetes, hypertension, heart disease, lung disease, cancer or is HIV positive.

Item 191. The method of Item 170, wherein the subject has not been treated with an immunosuppressant drug for more than 14 days in the last 6 months.

Item 192. The method of Item 170, wherein the subject has not received a live vaccine for at least 28 days prior to the administration and/or has not received an inactivated vaccine for at least 14 days prior to the administration.

Item 193. A method of stimulating an immune response in a subject, wherein the method comprises administering to the subject at least a first composition comprising the nucleic acid, preferably mRNA of any one of Items 1 to 73, the composition of any one of Items 74 to 162, the polypeptide of Item 163, the vaccine of Item 164 to 166, and/or the kit or kit of parts of Item 167.

Item 194. The method of Item 193, wherein the subject was previously infected with SARS CoV-2.

Item 195. The method of Item 193, wherein the subject was previously treated with at least a first SARS CoV-2 vaccine composition.

Item 196. The method of Item 195, wherein the first SARS CoV-2 vaccine composition was a mRNA vaccine.

Item 197. The method of Item 196, wherein the first SARS CoV-2 vaccine composition was BNT162 or mRNA-1273.

Item 198. The method of Item 195, wherein the first SARS CoV-2 vaccine composition was a protein subunit vaccine.

Item 199. The method of Item 198, wherein the first SARS CoV-2 vaccine composition was NVX-CoV2373 or COVAX.

Item 200. The method of Item 195, wherein the first SARS CoV-2 vaccine composition was an adenovirus vector vaccine.

Item 201. The method of Item 200, wherein the first SARS CoV-2 vaccine composition was ADZ1222 or Ad26.COV-2.S.

Item 202. The method of any one of Items 193-201, wherein the subject has detectable SARS CoV-2 binding antibodies.

Item 203. The method of Item 202, wherein the subject has detectable SARS CoV-2 S protein-binding antibodies.

Item 204. The method of Item 202, wherein the subject has detectable SARS CoV-2 N protein-binding antibodies.

Item 205. The method of any one of Items 195-201, wherein the first SARS CoV-2 vaccine composition was administered to the patient at least about 3 month, 6 months, 9 months, 1 year, 1.5 years, 2 years or 3 years ago.

Item 206. The method of any one of Items 195-201, wherein the first SARS CoV-2 vaccine composition was administered to the patient between about 3 months and 2 years ago or between about 6 months and 2 years ago.

Item 207. The method of any one of Items 193-206, wherein the method prevents moderate and severe COVID-19 disease in at least 80%, 85%, 90% or 95% of treated subjects.

Item 208. The method of Item 207, wherein the method prevents moderate and severe COVID-19 disease in at least 80%, 85%, 90% or 95% of treated subjects from about 2 weeks to about 1 year after said administration.

Item 209. The method of Item 207, wherein the method prevents moderate and severe COVID-19 disease in at least 80%, 85%, 90% or 95% of treated subjects from about 2 weeks to about 3 month, 6 months, 9 months, 1 year, 1.5 years, 2 years or 3 years after said administration.

Item 210. The method of any one of Items 193-209, wherein the method prevents SARS CoV-2 infection of the subject and/or SARS CoV-2 transmission from the subject in at least 50%, 55%, 60%, 65%, 70%, 75%, 80%, 85%, 90% or 95% of treated subjects.

Item 211. The method of Item 210, wherein the prevents SARS CoV-2 infection of the subject and/or SARS CoV-2 transmission from the subject in at least 50%, 55%, 60%, 65%, 70%, 75%, 80%, 85%, 90% or 95% of treated subjects from about 2 weeks to about 1 year after said administration.

Item 212. The method of Item 211, wherein the method prevents SARS CoV-2 infection of the subject and/or SARS CoV-2 transmission from the subject in at least 50%, 55%, 60%, 65%, 70%, 75%, 80%, 85%, 90% or 95% of treated subjects from about 2 weeks to about 3 month, 6 months, 9 months, 1 year, 1.5 years, 2 years or 3 years after said administration.

Item 213. The method of any one of Items 193-212, further comprising administering at least a second composition to the subject, the second composition comprising the nucleic acid, preferably mRNA of any one of Items 1 to 61, the composition of any one of Items 74 to 128, the polypeptide of Item 163, the vaccine of Item 164 to 166, and/or the kit or kit of parts of Item 167.

Item 214. The method of Item 213, wherein the second composition is administered at least about 7 days after said first composition.

Item 215. The method of Item 214, wherein the second composition is administered at least about 10 days, 14 days, 21 days, 28 days, 35 days, 42 days, 49 days or 56 days after said first composition.

Item 216. The method of Item 213, wherein the second composition is administered between about 7 days and about 56 days after said first composition.

Item 217. The method of Item 216, wherein the second composition is administered between: about 14 days and about 56 days; about 21 days and about 56 days; or about 28 days and about 56 days after said first composition.

Item 218. The method of any one of Items 193-212, further comprising administering at least a third composition to the subject, the third composition comprising the nucleic acid of any one of Items 1 to 61, the composition of any one of Items 74 to 162, the polypeptide of Item 163, the vaccine of Item 164 to 166, and/or the kit or kit of parts of Item 167.

Item 219. The method of any one of Items 213-218, wherein the method prevents moderate and severe COVID-19 disease in at least 80%, 85%, 90% or 95% of treated subjects.

Item 220. The method of Item 219, wherein the method prevents moderate and severe COVID-19 disease in at least 80%, 85%, 90% or 95% of treated subjects from about 2 weeks to about 1 year after administering the second or subsequent composition.

Item 221. The method of Item 219, wherein the method prevents moderate and severe COVID-19 disease in at least 80%, 85%, 90% or 95% of treated subjects from about 2 weeks to about 3 month, 6 months, 9 months, 1 year, 1.5 years, 2 years or 3 years after administering the second or subsequent composition.

Item 222. The method of any one of Items 193-221, further defined as a method of stimulating an antibody, a CD4+ T cell response or a CD8+ T-cell response in the subject.

Item 223. The method of any one of Items 193-221, further defined as a method of stimulating a neutralizing antibody response in the subject.

Item 224. The method of any one of Items 193-221, wherein the method stimulates an antibody response that produces between about 10 and about 500 coronavirus spike protein-binding antibodies for every coronavirus neutralizing antibody in the subject.

Item 225. The method of Item 224, wherein the method stimulates an antibody response that produces no more than about 200 spike protein-binding antibodies for every coronavirus neutralizing antibody.

Item 226. The method of Item 224, wherein the method stimulates an antibody response that produces between about 10 and about 300; about 20 and about 300; about 20 and about 200; or about 30 and about 100 coronavirus spike protein-binding antibodies for every coronavirus neutralizing antibody.

Item 227. The method of Item 226, wherein the method stimulates an antibody response that produces between about 30 and about 80 coronavirus spike protein-binding antibodies for every coronavirus neutralizing antibody.

Item 228. The method of Item 223, wherein the method stimulates an antibody response that produces between about 1 and about 500 coronavirus spike protein receptor binding domain (RBD)-binding antibodies for every coronavirus neutralizing antibody in the subject.

Item 229. The method of Item 228, wherein the method stimulates an antibody response that produces no more than about 50 spike protein RBD-binding antibodies for every coronavirus neutralizing antibody.

Item 230. The method of Item 228, wherein the method stimulates an antibody response that produces between about 1 and about 200; about 2 and about 100; about 3 and about 200; about 5 and about 100; or about 5 and about 50 spike protein RBD-binding antibodies for every coronavirus neutralizing antibody.

Item 231. The method of Item 230, wherein the method stimulates an antibody response that produces between about 5 and about 20 coronavirus spike protein RBD-binding antibodies for every coronavirus neutralizing antibody.

Item 232. The method of Item 222, wherein the subject has been previously infected with SARS-CoV-2.

Item 233. The method of Item 222, further defined as a method stimulating a protective immune response in the subject.

Item 234. The method of any one of Items 193-233, wherein the subject is a human subject.

Item 235. The method of Item 234, wherein the subject is between the ages of 6 months and 100 years, 6 months and 80 years, 1 year and 80 years, 1 year and 70 years, 2 years and 80 years or 2 years and 60 years.

Item 236. The method of Item 234, wherein the subject is a newborn or infant of an age of not more than 3 years, of not more than 2 years, of not more than 1.5 years, of not more than 1 year (12 months), of not more than 9 months, 6 months or 3 months, or is between 6 months and 2 years.

Item 237. The method of Item 234, wherein the subject is an elderly subject of an age of at least 50, 60, 65, or 70 years.

Item 238. The method of Item 237, wherein the subject is an elderly subject of an age of at least 60 years.

Item 239. The method of any one of Items 234 to 238, wherein the subject has native American, African, Asian or European heritage.

Item 240. The method of Item 238, wherein the subject has at least about 10%, 25%, or 50% native American, African, Asian or European heritage.

Item 241. The method of Item 238, wherein the subject has native American heritage.

Item 242. The method of Item 238, wherein the subject has at least about 10%, 25% or 50% native American heritage.

Item 243. The method of any one of Items 193-242, wherein the method induces essentially no increase in Th2 cytokines, preferably IL-4, IL-13, TNF and/or IL-1β in the subject Item 244. The method of any one of Items 193-242, further defined as a method of inducing a Th1 directed immune response in the subject.

Item 245. The method of any one of Items 193-244, wherein the subject is receiving anti-coagulation therapy.

Item 246. The method of any one of Items 193-245, wherein the composition is administered by intramuscular injection.

Item 247. The method of any one of Items 193-246, wherein the composition comprises a mRNA encoding a coronavirus spike protein (S) that is a pre-fusion stabilized spike protein (S_stab) comprising at least one pre-fusion stabilizing mutation.

Item 248. The method of Item 247, wherein the mRNA encodes a coronavirus spike protein at least 95% identical to SEQ ID NO: 163.

Item 249. The method of Item 248, wherein the mRNA encodes a coronavirus spike protein identical to SEQ ID NO: 163.

Item 250. The method of Item 247, wherein the mRNA encodes a coronavirus spike protein at least 95% identical to SEQ ID NO: 149.

Item 251. The method of Item 248, wherein the mRNA encodes a coronavirus spike protein identical to SEQ ID NO: 149.

Item 252. The method of Item 250 or 251, wherein a single dose of the composition provides a sufficient immune response to protect the subject from severe COVID-19 disease for at least about 6 months.

Item 253. The method of Item 252, wherein a single dose of the composition provides a sufficient immune response to protect the subject from severe COVID-19 disease for about 6 months to about 1 year, 1.5 years, 2 years, 2.5 years, 3 years, 4 years or 5 years.

Item 254. The method of any one of Items 247-249, wherein the mRNA is complexed with one or more lipids thereby forming LNP.

Item 255. The method of Item 254, wherein the LNP comprises
(i) at least one cationic lipid;
(ii) at least one neutral lipid;
(iii) at least one steroid or steroid analogue; and
(iv) at least one PEG-lipid,
wherein (i) to (iv) are in a molar ratio of about 20-60% cationic lipid, 5-25% neutral lipid, 25-55% sterol, and 0.5-15% PEG-lipid.

Item 256. The method of Item 255, wherein the LNP comprises
(i) at least one cationic lipid according to formula III-3;
(ii) DSPC;
(iii) cholesterol; and
(iv) a PEG-lipid, according to formula IVa,
wherein (i) to (iv) are in a molar ratio of about 20-60% cationic lipid, 5-25% neutral lipid, 25-55% sterol, and 0.5-15% PEG-lipid.

Item 257. The method of Item 256, wherein the LNP comprises
(i) at least one cationic lipid according to formula III-3;
(ii) DSPC;
(iii) cholesterol; and
(iv) a PEG-lipid, according to formula IVa,
wherein (i) to (iv) are in a molar ratio of about 47.5:10:40.8:1.7.

Item 258. The method of Item 256, wherein the LNP comprises
(i) at least one cationic lipid according to formula III-3;
(ii) DSPC;
(iii) cholesterol; and
(iv) a PEG-lipid, according to formula IVa,
wherein (i) to (iv) are in a molar ratio of 47.4:10:40.9:1.7.

Item 259. The method of anyone of Items 254-258, wherein the ratio of mRNA to total lipid is about 0.03-0.04 w/w.

Item 260. The method of Item 249, wherein the mRNA is complexed with one or more lipids thereby forming lipid nanoparticles (LNP), wherein the LNP comprises
(i) at least one cationic lipid according to formula III-3;
(ii) DSPC;
(iii) cholesterol; and
(iv) a PEG-lipid, according to formula IVa,
wherein (i) to (iv) are in a molar ratio of about 47.5:10:40.8:1.7, and
wherein the ratio of mRNA to total lipid is about 0.03-0.04 w/w.

Item 261. The method of Item 249, wherein the mRNA is complexed with one or more lipids thereby forming lipid nanoparticles (LNP), wherein the LNP comprises
(i) at least one cationic lipid according to formula III-3;
(ii) DSPC;
(iii) cholesterol; and
(iv) a PEG-lipid, according to formula IVa,
wherein (i) to (iv) are in a molar ratio of 47.4:10:40.9:1.7, and
wherein the ratio of mRNA to total lipid is about 0.03-0.04 w/w.

Item 262. The method of any one of Items 247-261, wherein the subject is administered a composition that comprises between about 2 μg and about 50 μg of mRNA.

Item 263. The method of Item 262, wherein the subject is administered a composition that between about 10 μg and about 50 μg of mRNA.

Item 264. The method of Item 263, wherein the subject is administered a composition that between about 10 μg and about 30 μg of mRNA.

Item 265. The method of Item 264, wherein the subject is administered a composition that comprises about 12 μg of mRNA.

Item 266. The method of any one of Items 264 to 265, wherein the administration provides seroconversion in 100% of subjects to which the composition is administered.

Item 267. The method of any one of Items 193 to 266, wherein the human subject is 61 years of age or older.

Item 268. The method of any one of Items 193 to 266, wherein the human subject is 18 to 60 years of age.
Item 269. The method of any one of Items 193 to 268, wherein the human subject has had a previous vaccine allergy.
Item 270. The method of any one of Items 193 to 269, wherein the subject has detectable anti-PEG antibodies.
Item 271. The method of the any one of Items 193 to 270 comprising:
(i) obtaining a composition of any one of Items 74 to 162, wherein the composition is lyophilized;
(ii) solubilizing the lyophilized composition in a pharmaceutically acceptable liquid carrier to produce a liquid composition; and
(iii) administering an effective amount of the liquid composition to the subject.
Item 272. A method of stabilizing a composition of any one of Items 74 to 162 comprising lyophilizing the composition to a produce a stabilized composition.
Item 273. The method of Item 272, wherein the stabilized composition has a water content of less than about 10%.
Item 274. The method of Item 273, wherein the stabilized composition has a water content of between about 0.5% and 5.0%.
Item 275. A stabilized, lyophilized composition produced by a method of any one of Items 272-274.

Brief Description of Lists and Tables

List A: Exemplary SARS-CoV-2 coronavirus isolates
List B: GenBank Accession Numbers of different SARS-CoV-2 isolates
List 1: Exemplary suitable protein designs of the invention
Table A: Intensity Grading for Solicited Local Adverse Events
Table B: Intensity Grading for Solicited Systemic Adverse Events
Table 1: Preferred coronavirus constructs (amino acid sequences and nucleic acid coding sequences)
Table 2: Human codon usage table with frequencies indicated for each amino acid
Table 3a: Nucleic acid, preferably mRNA constructs suitable for a coronavirus vaccine
Table 3b: Nucleic acid, preferably mRNA constructs suitable for a coronavirus vaccine
Table 4: RNA constructs encoding different SARS-CoV-2 S antigen design (used in the Examples)
Table A: Lipid-based carrier composition of the examples
Table 5: Overview of mRNA constructs used in Example 2a
Table 6: Overview of mRNA constructs used in Example 2b
Table 7: Overview of mRNA constructs used in Example 2c
Table 8: Vaccination regimen (Example 3)
Table 9: Vaccination regimen (Example 4)
Table 10: Vaccination regimen (Example 5)
Table 11: Vaccination regimen (Example 6)
Table 12: Vaccination regimen (Example 7)
Table 13: Vaccination regimen (Example 8)
Table 14: Vaccination regimen (Example 9)
Table 15: List of histopathological analysis indicated in FIG. 12F:
Table 16: Vaccination regimen (Example 11)
Table 17: Vaccination regimen (Example 12)
Table 18: Primary and Supportive Populations for the Analysis of Each Endpoint
Table 19: Two Stage Group Sequential Design with Interim Analyses at 56 and 111 Cases and Final Analysis at 185 Cases
Table 20: Vaccination regimen (Example 14)
Table 21: Vaccination regimen (Example 15)
Table 22: Vaccination regimen (Example 16)
Table 23: Vaccination regimen (Example 17)
Table 24: Vaccination regimen (Example 18)
Table 25: List of emerging SARS-CoV-2 isolates/variants (Example 19)

BRIEF DESCRIPTION OF THE DRAWINGS

FIG. 1 shows that mRNA constructs encoding different SARS-CoV-2 S protein designs led to a detectable protein expression using an in vitro translation system. Further details provided in Example 2a and Table 5.

FIG. 2 shows that mRNA constructs encoding different SARS-CoV-2 S protein designs are expressed on the cell surface of mammalian cells using FACS analysis. Further details provided in Example 2b and Table 6.

FIG. 3 shows that mRNA constructs encoding different SARS-CoV-2 S proteins are expressed in mammalian cells using western blot analysis. Further details provided in Example 2c and Table 7.

FIG. 4 shows significant IgG1 and IgG2a responses for group vaccinated with the mRNA vaccine encoding full length stabilized S protein. FIG. 4 shows comparable IgG1 response for the mRNA vaccine and the rec. SARS-CoV-S protein and higher IgG2a titers for the mRNA vaccine compared to the rec. SARS-CoV-S protein. IgG1 and IgG2a antibody titers assessed by ELISA using rec. SARS-CoV-2 S protein as a coating reagent. The experiment was performed as described in Example 5. Further construct details are provided in Table 10.

FIGS. 5A-C show significant IgG1 and IgG2a responses for group vaccinated with the mRNA vaccine encoding full length stabilized S protein and full length wildtype S protein. FIG. 5A shows comparable IgG1 response for both full length S protein designs and FIG. 5B shows comparable IgG2a titers for both full length S protein designs. FIG. 5C shows high and comparable virus neutralizing titers for both full-length S protein designs at day 42. The experiments were performed as described in Example 6. Further construct details are provided in Table 11.

FIG. 6 shows that LNP formulated mRNA encoding full length stabilized S protein and full length S protein induces cellular immune responses in mice (CD8+ and/or CD4+ T cell responses), using an intracellular cytokine staining assay. Groups A-C LNP formulated mRNA encoding different full-length S protein designs; Group D negative control. Vaccination scheme see Table 11. Further details provided in Example 6.

FIG. 7 shows innate immune responses after vaccination with LNP formulated mRNA encoding full-length S protein (S_stab) (group A). The dotted lines indicate the lower limit of detection. The experiment was performed as described in Example 7. Further construct details are provided in Table 12.

FIG. 8A shows significant IgG1 and IgG2a responses for groups vaccinated with the mRNA vaccine encoding full length stabilized S protein. FIG. 8A shows high IgG1 responses and high IgG2a responses after first vaccination. Groups A-D: one vaccination with LNP formulated mRNA encoding full-length S protein (S_stab); Group I: adjuvanted recombinant spike protein and Group J: negative control. The experiments were performed as described in Example 7. Further construct details are provided in Table 12.

FIG. 8B shows significant IgG1 and IgG2a responses for all groups vaccinated with the mRNA vaccine encoding full length stabilized S protein (s_stab). FIG. 8B (A) shows IgG1 response at day 28 (after first vaccination) and at day 35

(after second vaccination) and FIG. 8B (B) shows IgG2a response at day 28 (after first vaccination) and at day 35 (after second vaccination). Groups A-H: LNP formulated full-length S protein mRNA with different vaccination intervals; Group I: adjuvanted recombinant spike protein and Group J: negative control. The experiments were performed as described in Example 7. Further construct details are provided in Table 12.

Figure 9A:
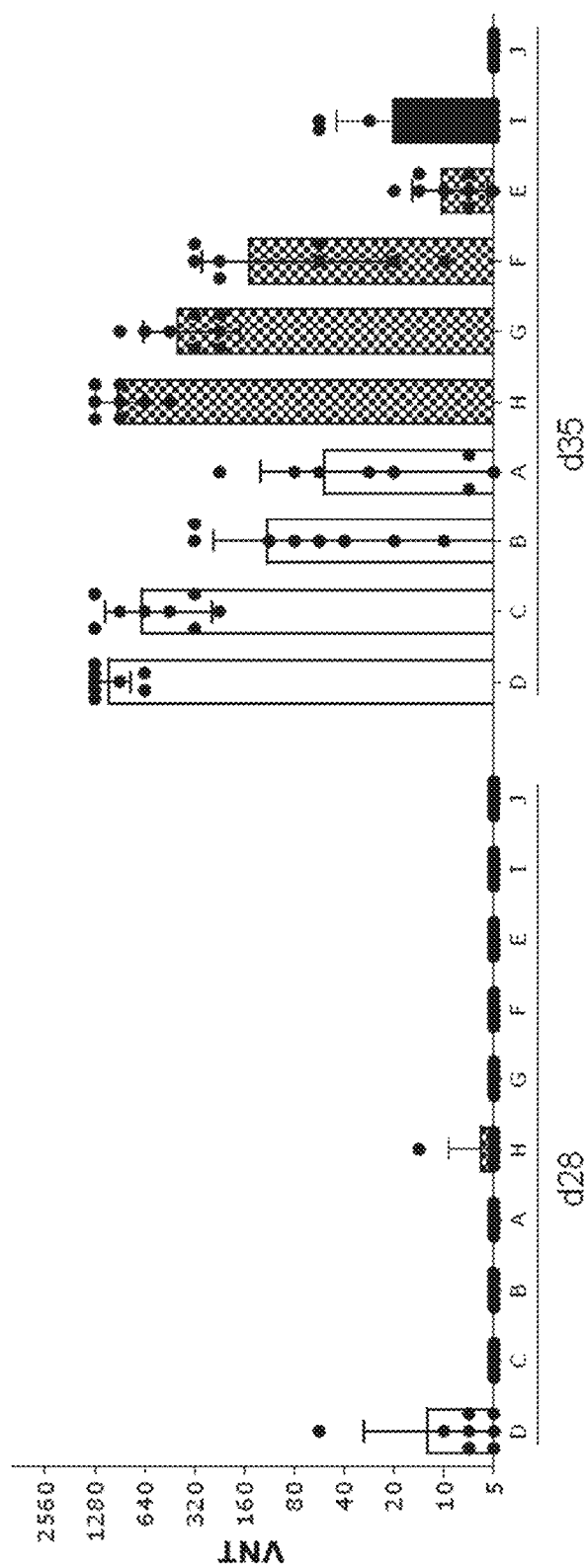
Figure 9B:
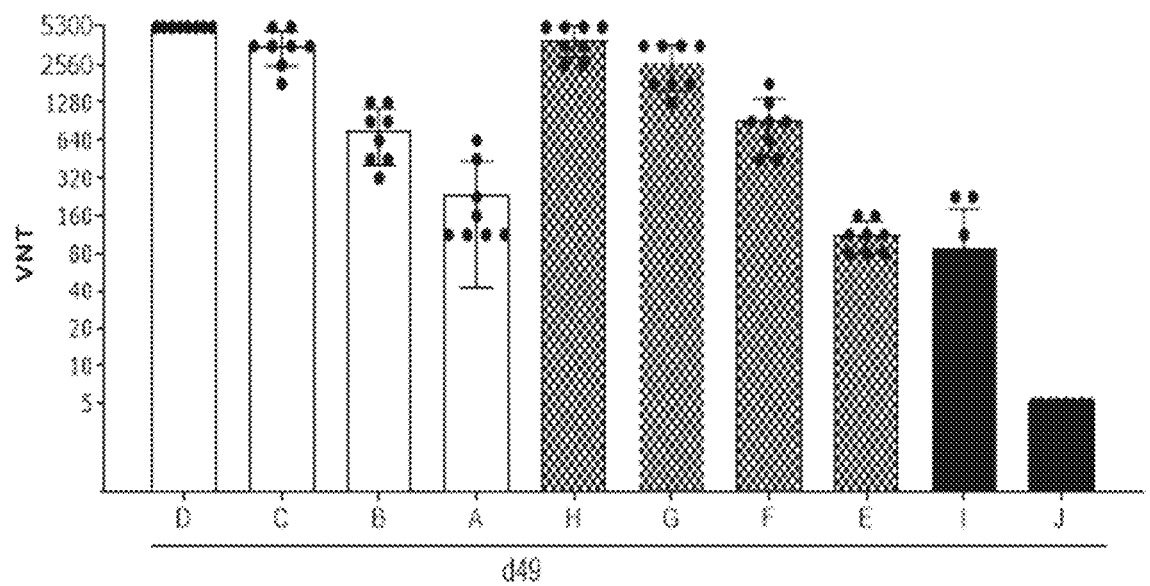

FIGS. 9A-B show significant induction of virus neutralizing titers (VNT) for all groups vaccinated with the mRNA vaccine encoding full length stabilized S protein (S_stab). FIG. 9A shows VNT at day 28 (after first vaccination) and at day 35 and at day 49 (FIG. 9B) (after second vaccination) Groups A-H: LNP formulated full length S protein mRNA with different vaccination intervals; Group I: adjuvanted recombinant spike protein and Group J: negative control. The experiments were performed as described in Example 7. Further construct details are provided in Table 12.

FIG. 10 shows that LNP formulated mRNA encoding full length stabilized S protein (S_stab) induces cellular immune responses in mice (CD8+ and/or CD4+ T-cell responses) after second vaccination with different time intervals between prime and boost vaccination, using an intracellular cytokine staining assay. Groups A-H: LNP formulated full length S protein mRNA with different vaccination intervals; Group I: adjuvanted recombinant spike protein and Group J: negative control. The experiments were performed as described in Example 7. Further construct details are provided in Table 12.

FIGS. 11A-G show significant antibody responses in rats for groups vaccinated with different doses of the mRNA vaccine encoding full length stabilized S protein (S_stab). FIG. 11A shows high IgG1 responses for groups C-F, FIG. 11B shows high IgG2a responses for groups D-F and FIG. 11C shows high total IgG response for groups C-E. Groups B-F: different doses of LNP formulated full length S protein mRNA and group A: negative control. FIG. 11D shows further increased IgG1 antibody responses and FIG. 11E shows further increased IgG2a antibody titers for all groups after second vaccination at day 42. FIGS. 11F and G show that vaccination with mRNA full length S stabilized protein formulated in LNPs induced in rats dose dependent levels of VNTs. The experiments were performed as described in Example 8. Further construct details are provided in Table 13.

Figure 12C:
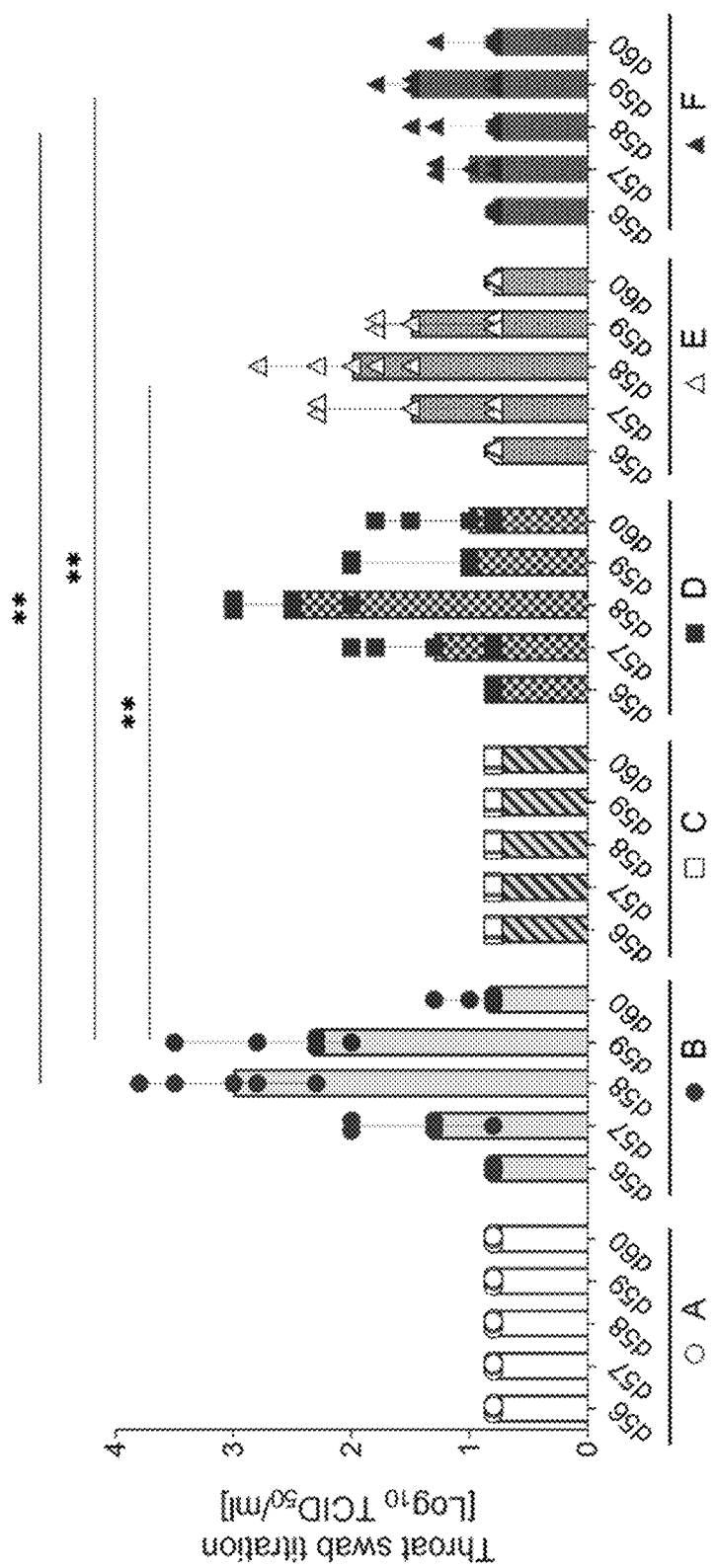
Figure 12F:
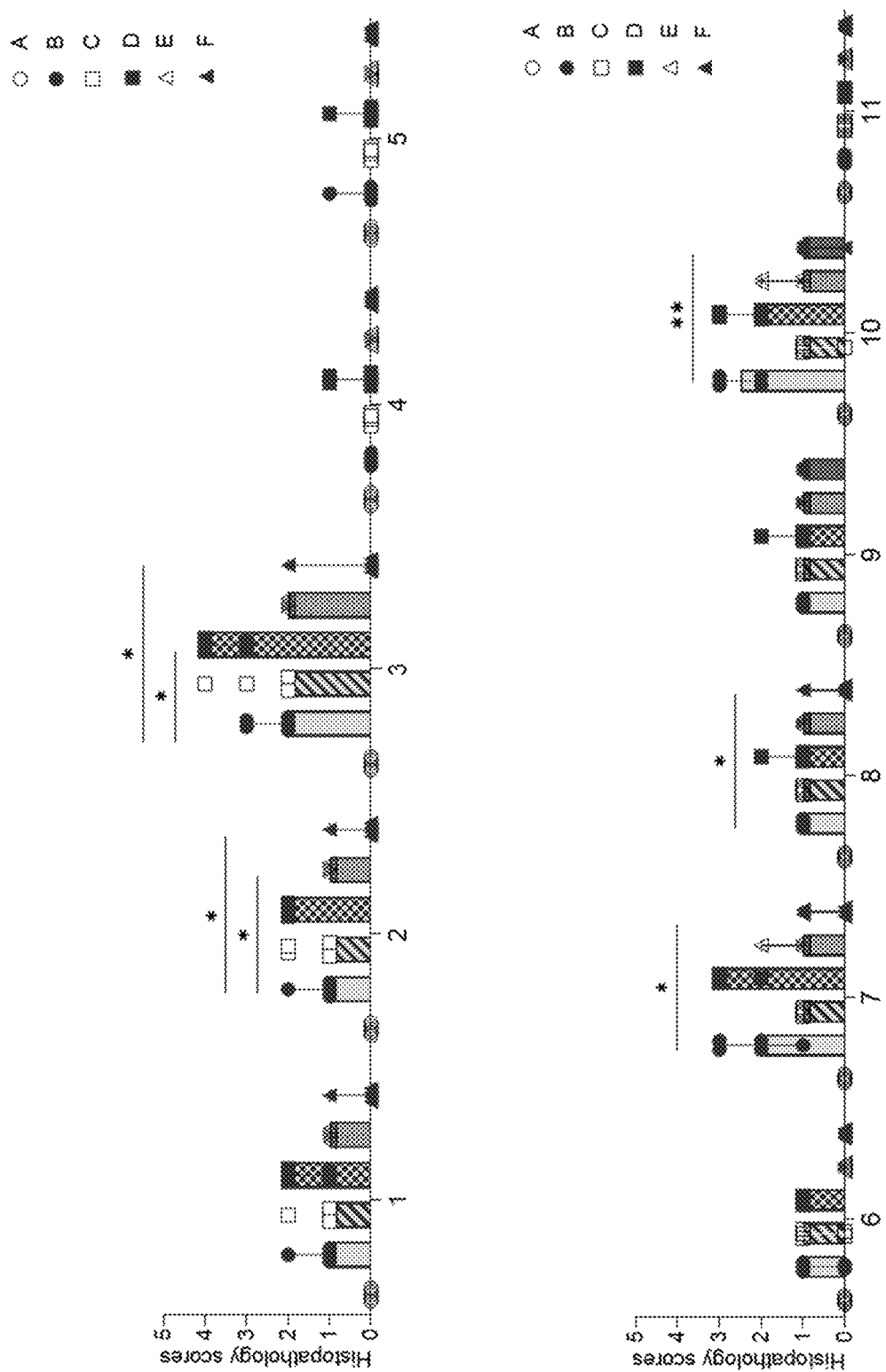

FIGS. 12A-F show protection of hamsters from SARS-CoV-2 challenge vaccinated with different the inventive mRNA vaccine encoding full length stabilized S protein (S_stab). FIG. 12A shows the induction of high total IgG antibodies for vaccinated groups E and F and FIG. 12B shows the dose-dependent induction of VNTs upon one (day 28) or two vaccinations (day 42 and day 56). FIGS. 12C-E show detectable levels of replication competent virus in throat swabs on days 56 to day 60 (FIG. 12C), nasal turbinate on day 60 (FIG. 12D) and lung tissues on day 60 (FIG. 12F). Each dot represents an individual animal, bars depict the median. Statistical analysis was performed using Mann-Whitney testing. FIG. 12F shows the protection of the respiratory tract of vaccinated hamsters from challenge infection in the absence of signs of vaccine enhanced disease. Histopathological analysis was performed on day 60, four days post challenge infection, on formalin-fixed, paraffin embedded tissues sections. Histopathological assessment scoring was performed according to severity of inspected parameter. Each dot represents an individual animal, bars depict the median, Statistical analysis was performed using Mann-Whitney testing. The experiments were performed as described in Example 9. Further details are provided in Table 14 and Table 15.

Figure 13A:
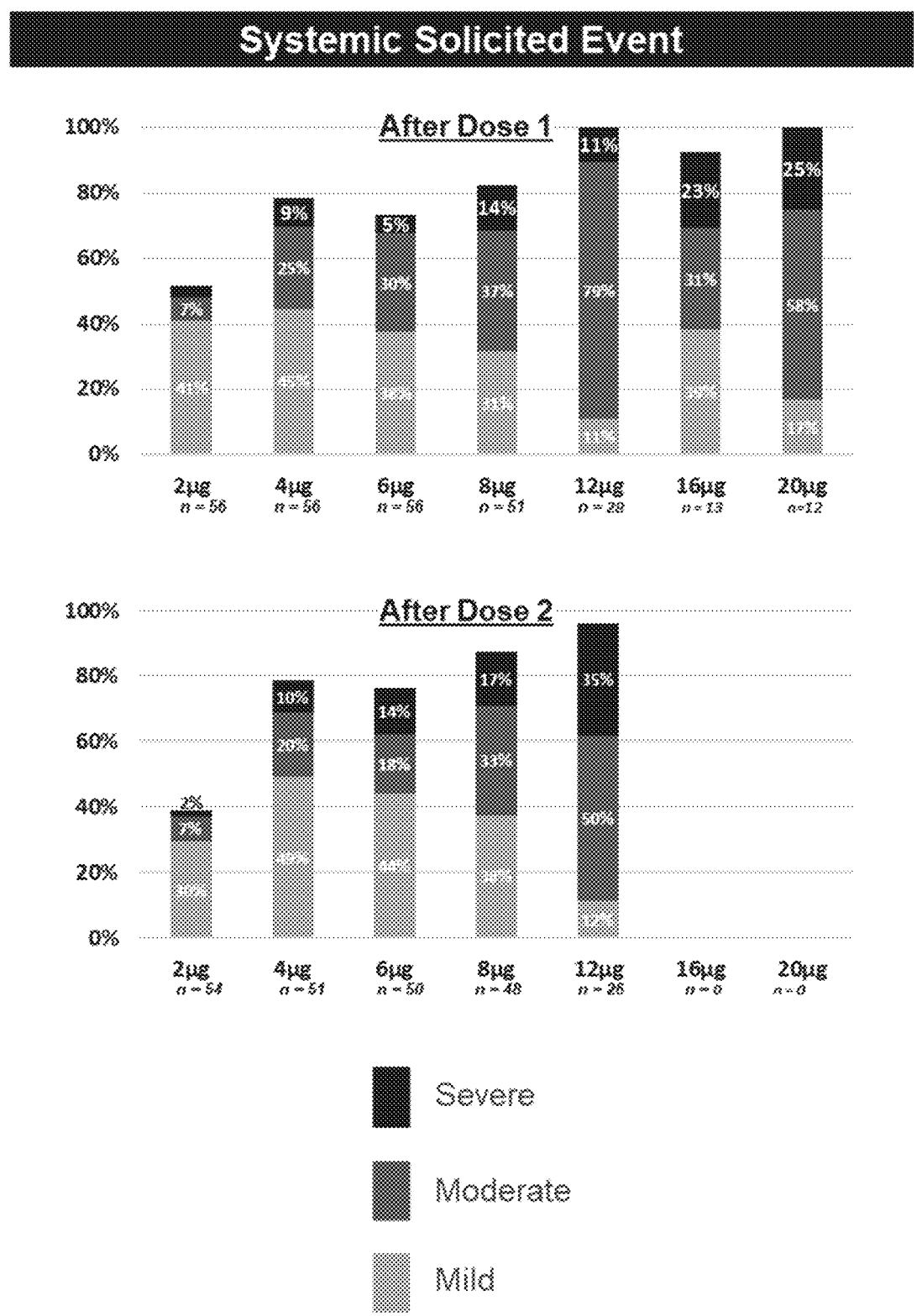
Figure 13C:
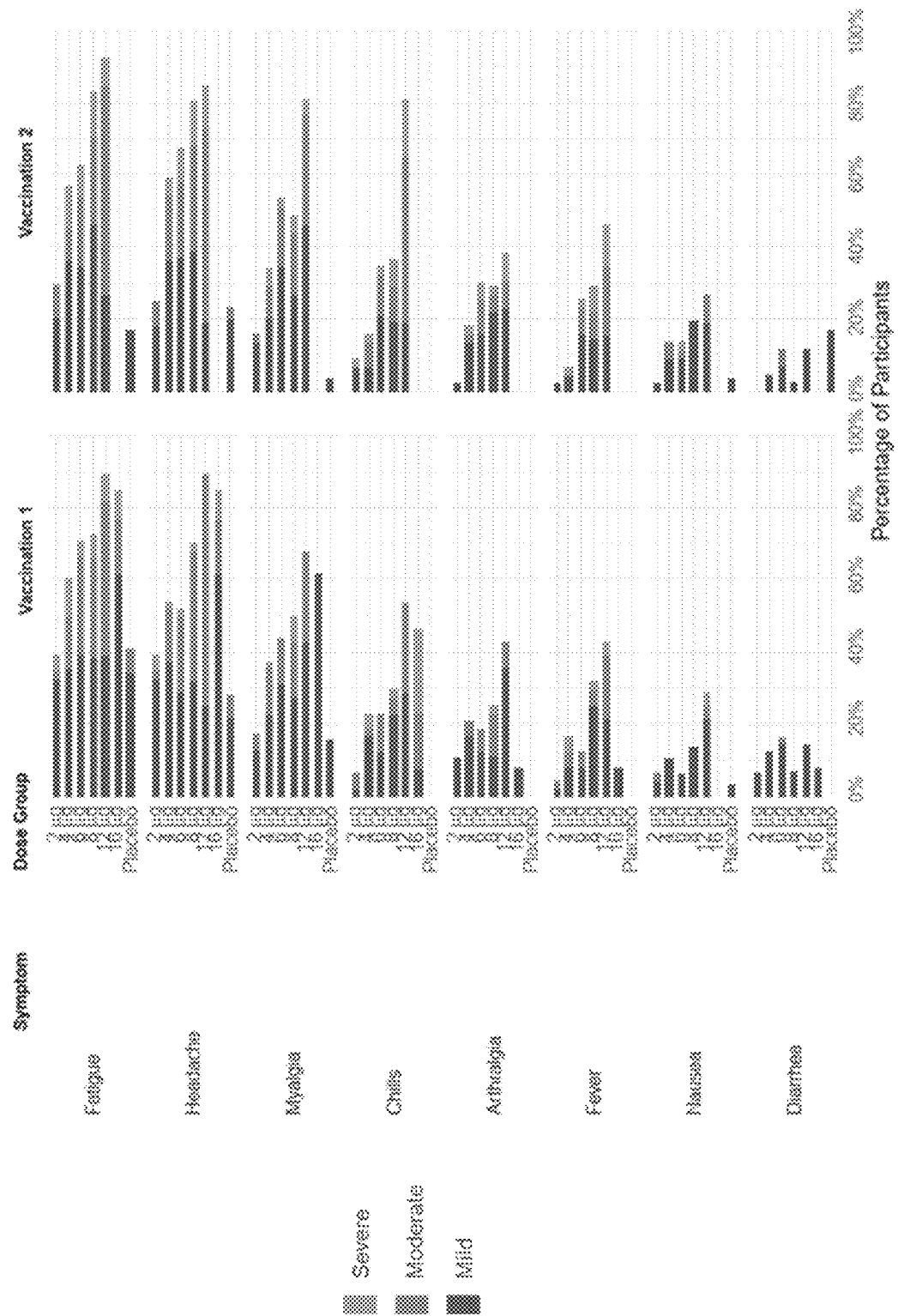
Figure 13D:
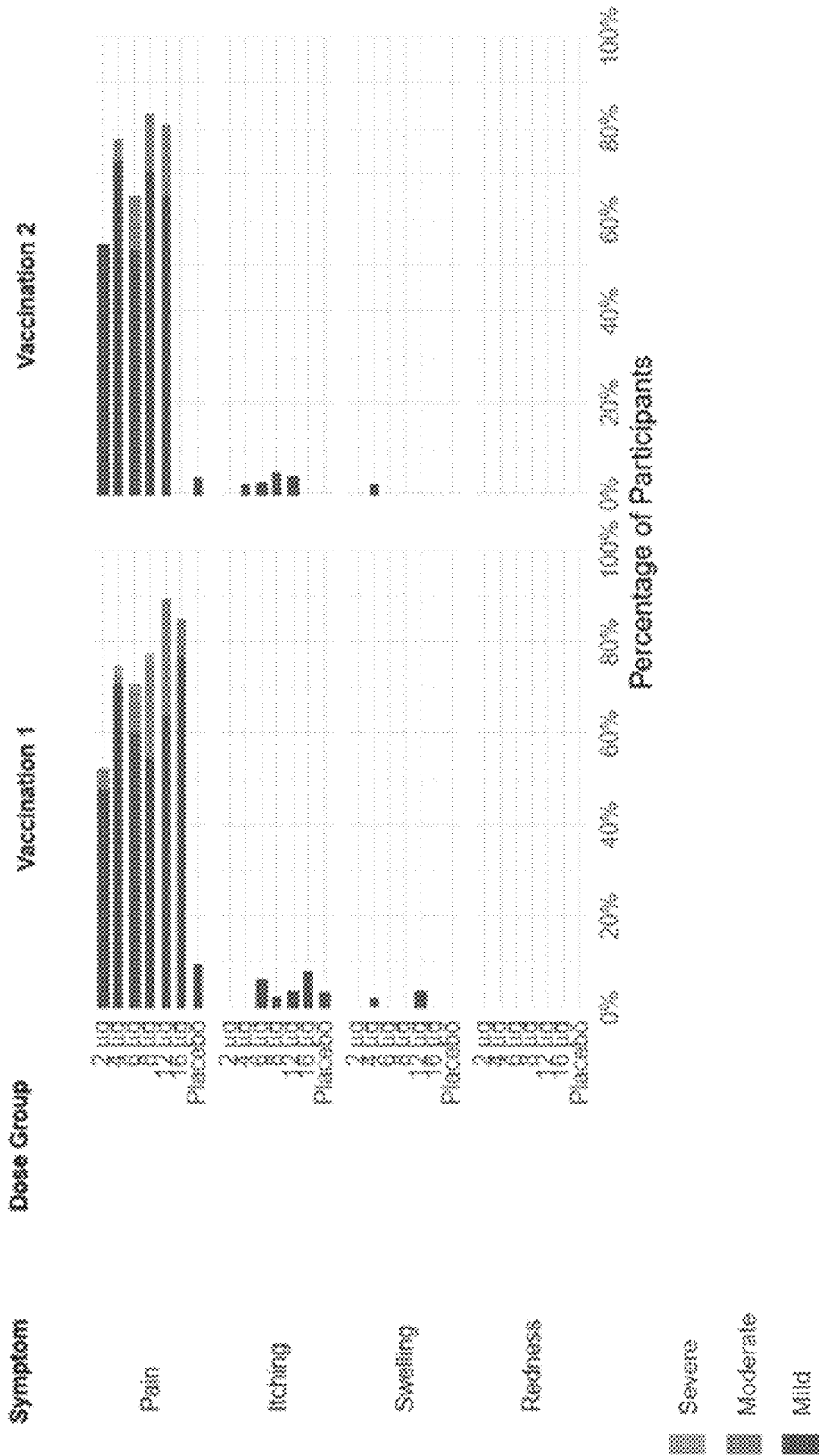
Figure 13E:
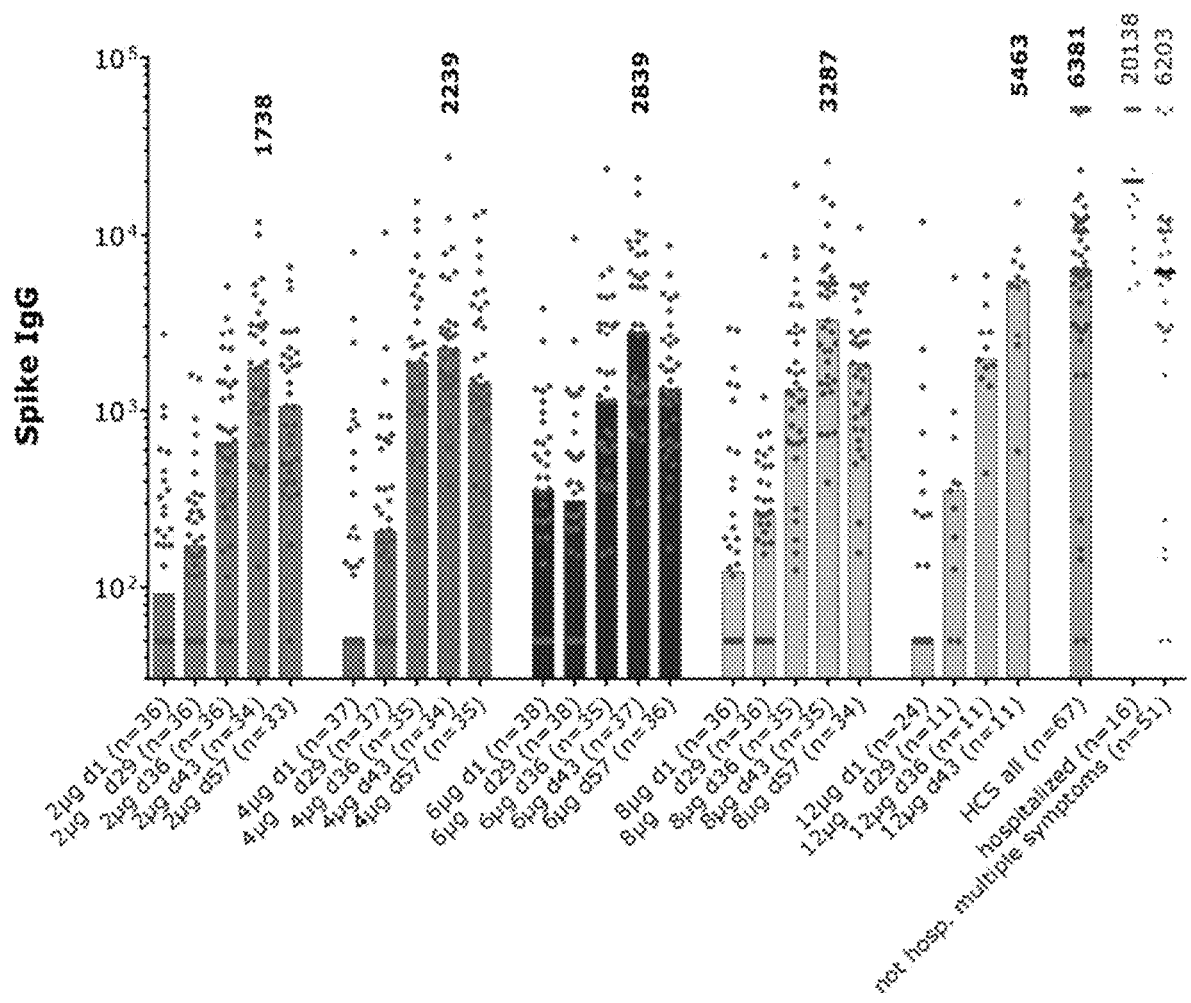
Figure 13F:
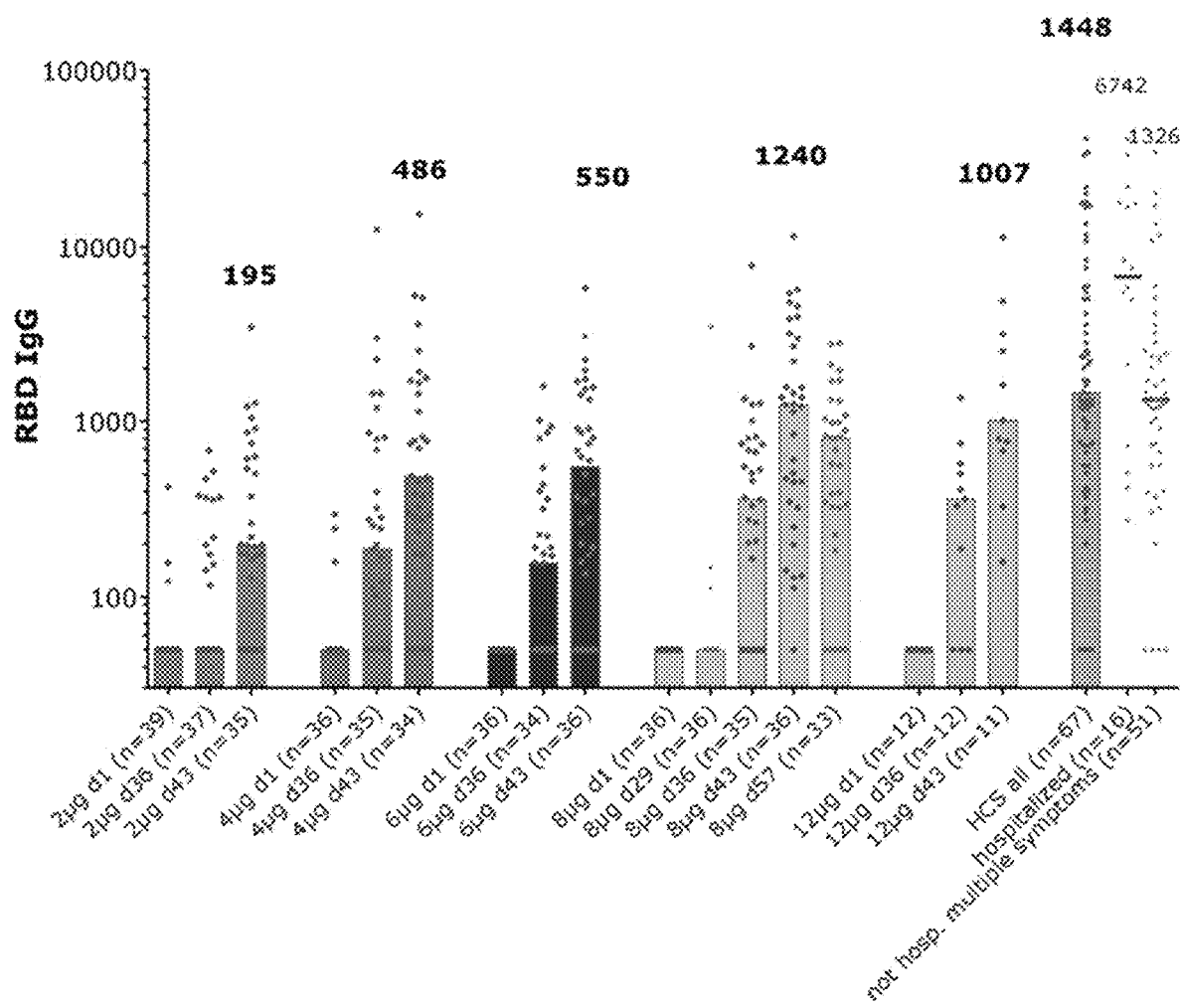
Figure 13G:
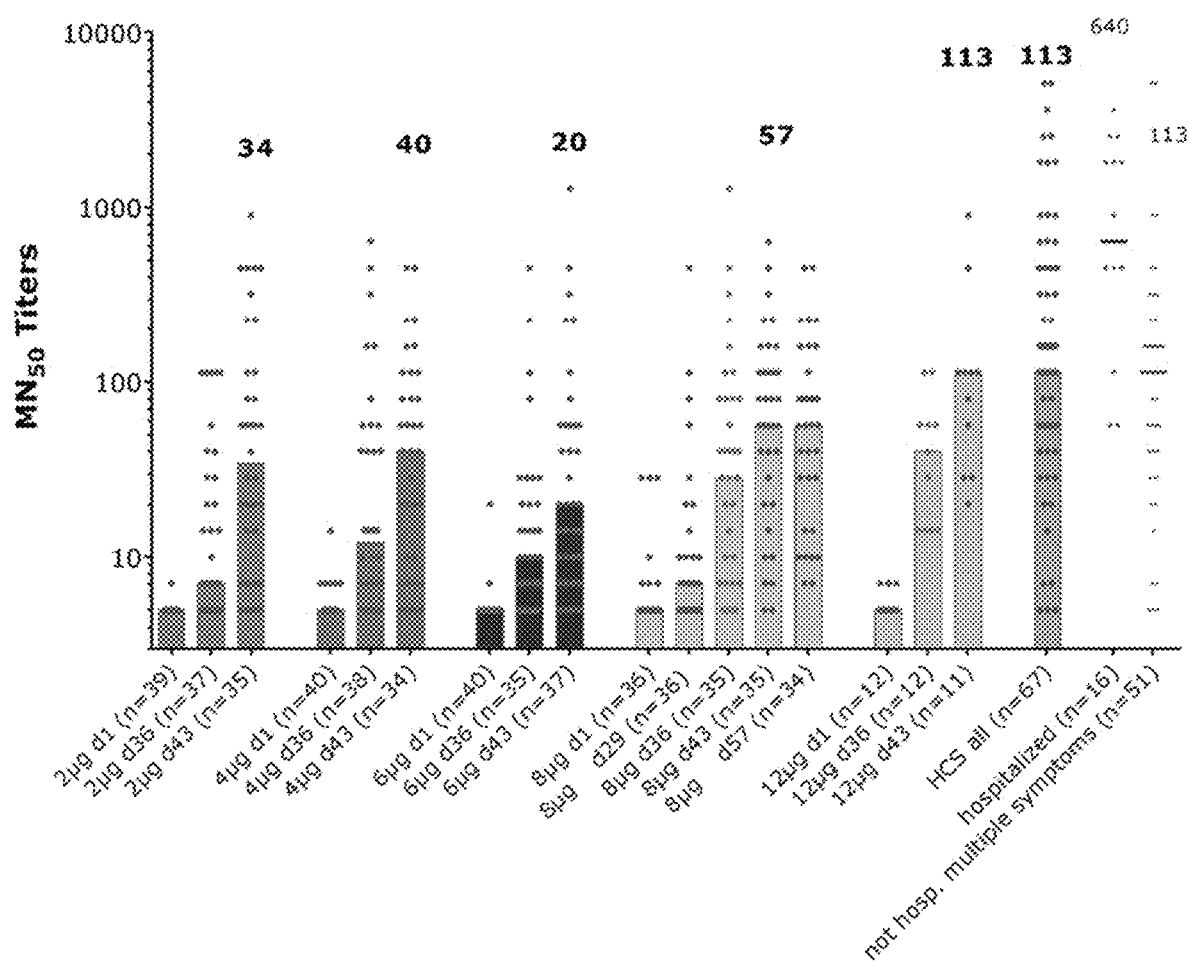
Figure 13H:
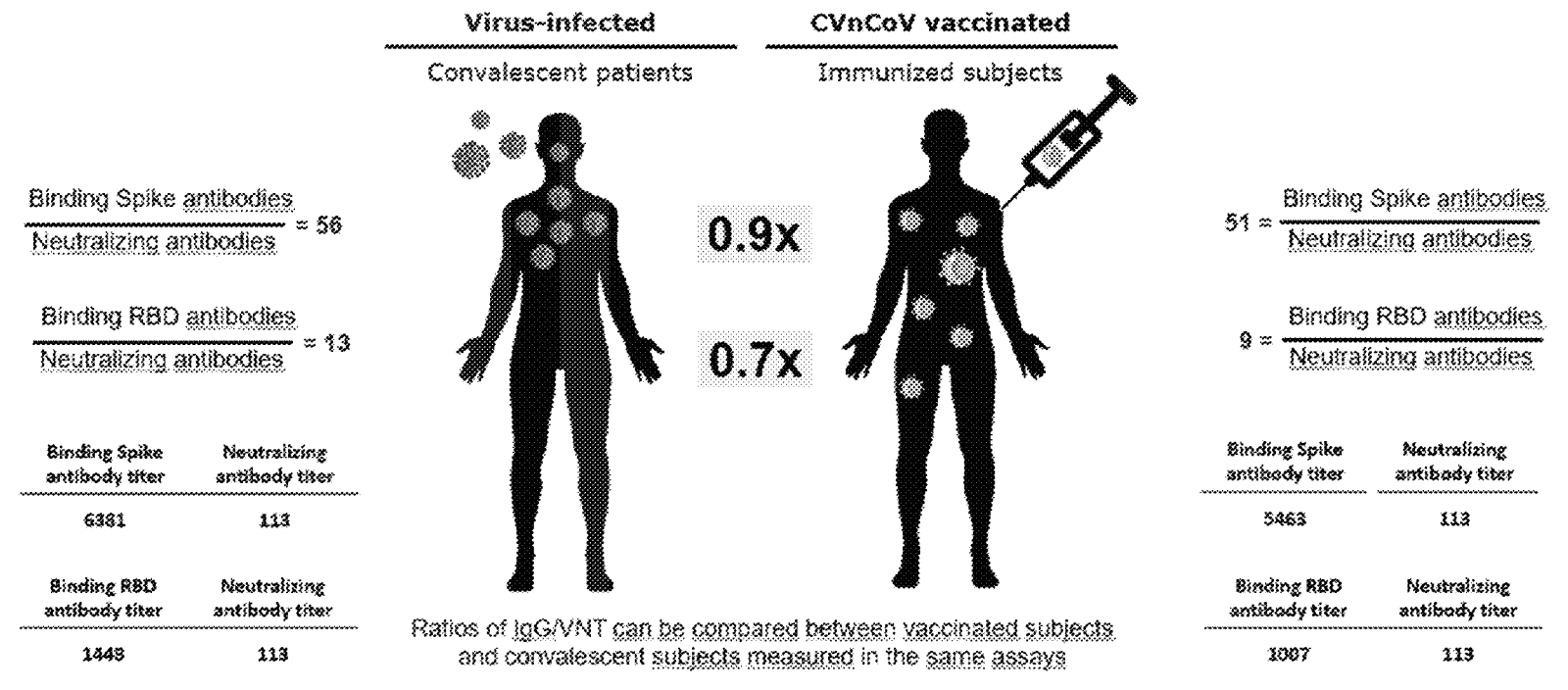
Figure 13I:
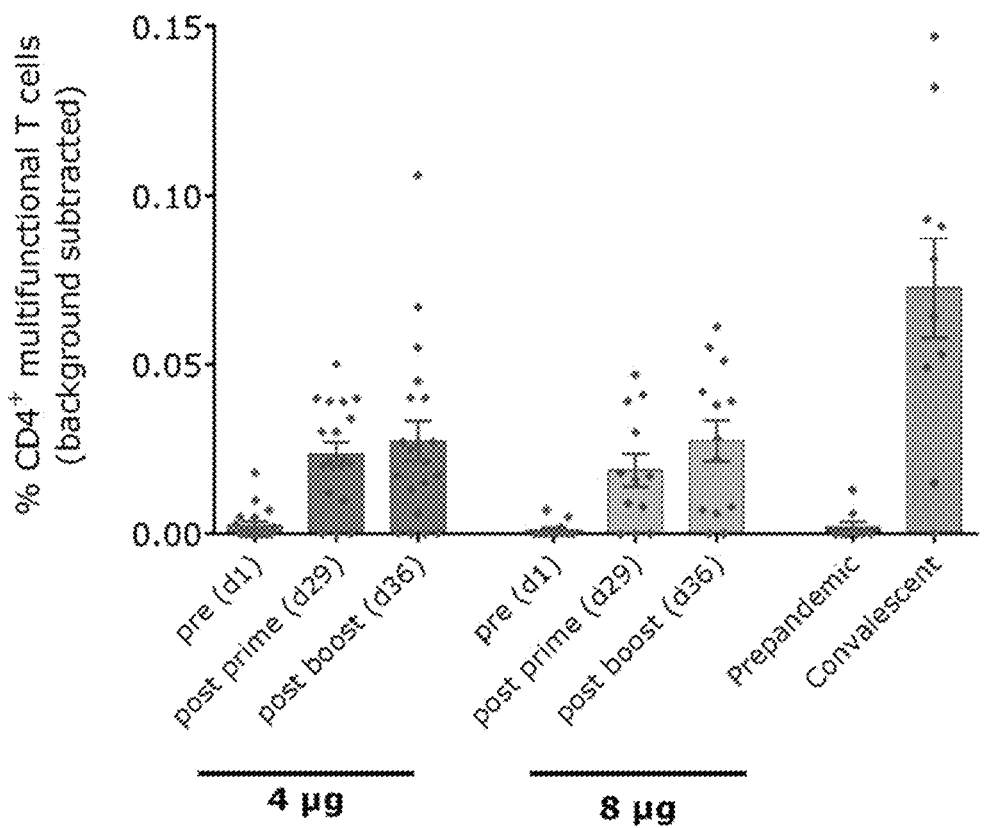
Figure 13J:
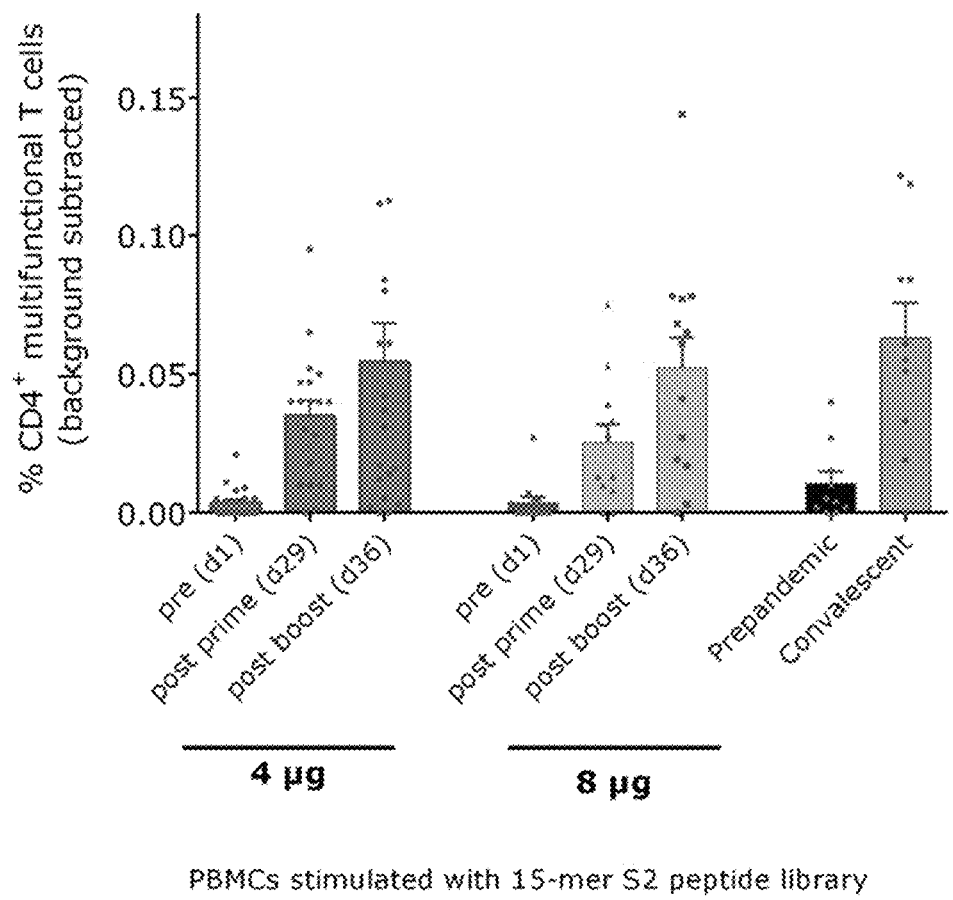
Figure 13K:
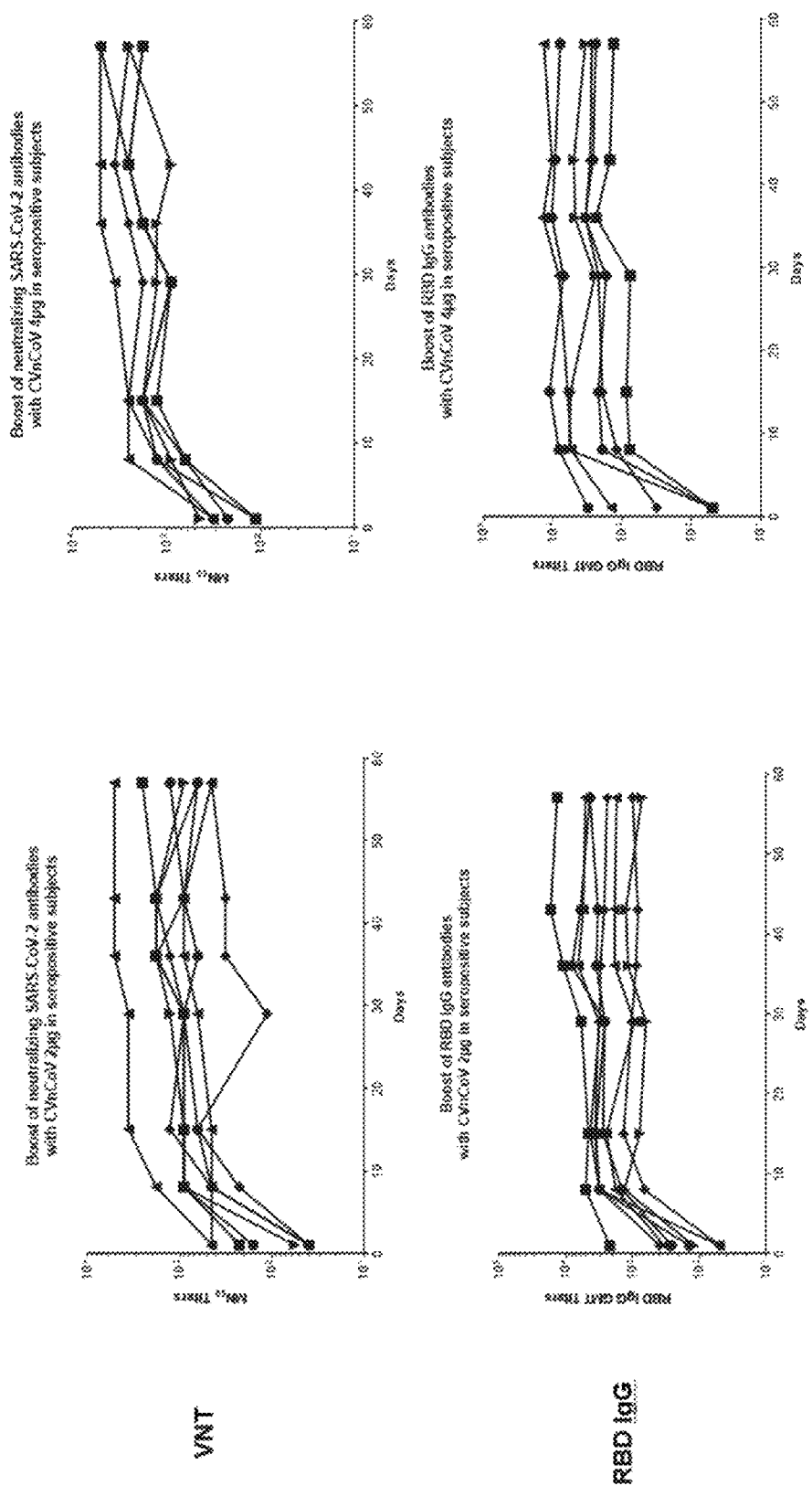

FIGS. 13A-K show the results of a phase I clinical trial in healthy human subjects. In FIG. 13A systemic adverse events are shown in the different dose cohorts after the first dose and after the second dose. In FIG. 13B local adverse events are shown in the different dose cohorts after the first dose and after the second dose. In FIG. 13C the specific systemic adverse events are shown, such as fatigue, headache, myalgia, chills, arthralgia, fever, nausea and diarrhea. In FIG. 13D the specific local adverse events are shown, such as pain, itching, swelling and redness. In FIG. 13E induction of Spike protein specific IgG antibodies on day 1, 29, 36, 43 and 57 is shown for the different dose cohorts. In the table of FIG. 13E percentage of seroconversion of the vaccinated subjects is shown. In FIG. 13F induction of RBD-specific IgG antibodies on day 1, 36, and 43 is shown for the different dose cohorts. In the table of FIG. 13F percentage of seroconversion of the vaccinated subjects is shown. In FIG. 13G induction of virus neutralizing antibodies is shown. In the table of FIG. 13G percentage of seroconversion of the vaccinated subjects is shown. In FIG. 13H the ratios of the level of Spike protein or RBD binding antibodies to the level of neutralizing antibodies are shown. FIG. 13I shows induction of CD4+ T cells against Spike protein S1 after the first dose (day 29) and the second dose (day 36). FIG. 13J shows induction of CD4+ T cells against Spike protein S2 after the first dose (day 29) and the second dose (day 36). In FIG. 13K induction of virus neutralizing titers and RBD specific antibodies in SARS-CoV-2 seropositive subjects after vaccination with 2 µg and 4 µg CvnCoV is shown.

FIGS. 14A-C show significant IgG1 and IgG2a responses after the vaccination with mRNA encoding full length S stabilized protein (S_stab) after a single vaccination (d21) and more increased after a second vaccination (d42) (FIG. 14A). Vaccine composition comprising mRNA encoding SARS-CoV-2 S_stab comprising hSL-A100 and the UTR combination a-1 (HSD17B4/PSMB3) (group C) shows an improved and stronger induction of binding antibodies (shown by IgG1 and IgG2a endpoint titers). The induction of VNT is shown in FIG. 14B. Mice of group C showed an early increased level of VNTs already on d21 after first vaccination compared to group B. The induction of T-cell immunity is shown in FIG. 14C. Vaccine composition comprising mRNA encoding SARS-CoV-2 S_stab comprising hSL-A100 and the UTR combination a-1 (HSD17B4/PSMB3) (group C) shows surprisingly a remarkable stronger induction of $CD8^+$ IFNγ/TNF double positive T cells.

Figure 15A:
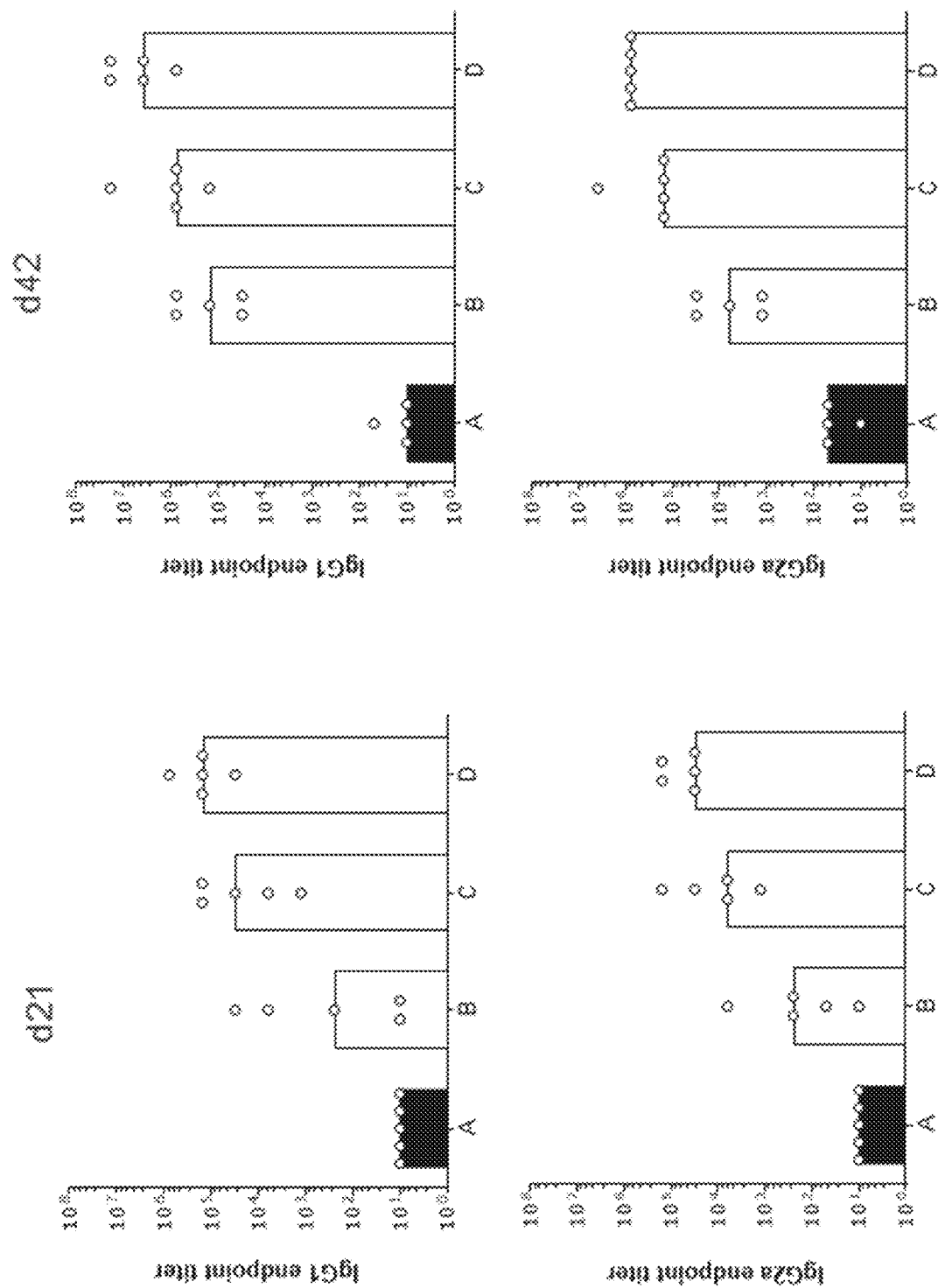

FIGS. 15A-B show significant antibody responses in rats for groups vaccinated with different doses of the mRNA vaccine encoding full length stabilized S protein (S_stab) comprising the alternative non-coding region with 3' end hSL-A100 and the UTR combination a-1 (HSD17B4/PSMB3) formulated in LNPs. FIG. 15A shows a robust induction of IgG1 and IgG2a binding antibodies and FIG. 15B the induction of VNTs in a dose-dependent manner. The experiments were performed as described in Example 12. Further construct details are provided in Table 17.

Figure 16A:
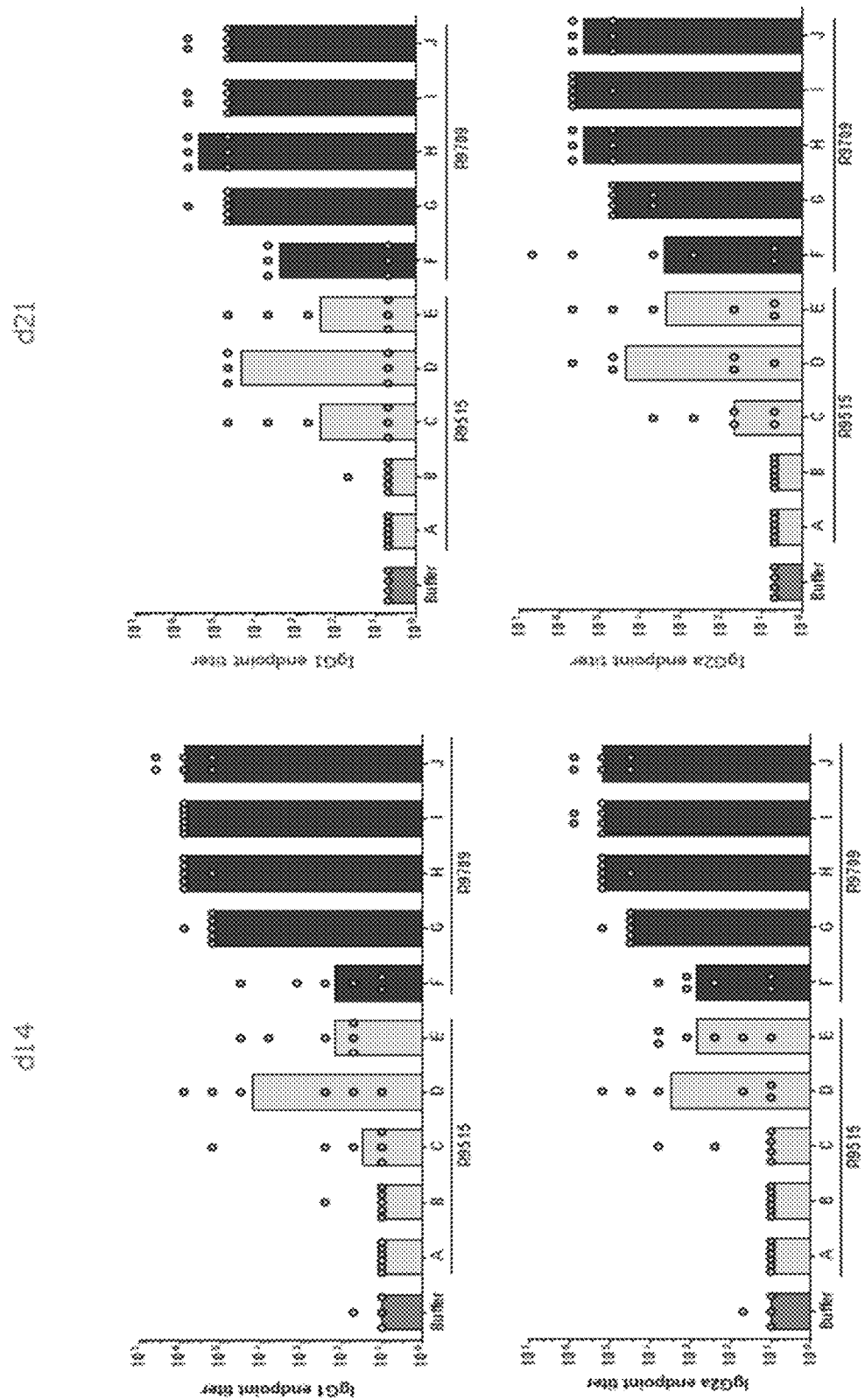
Figure 16B:
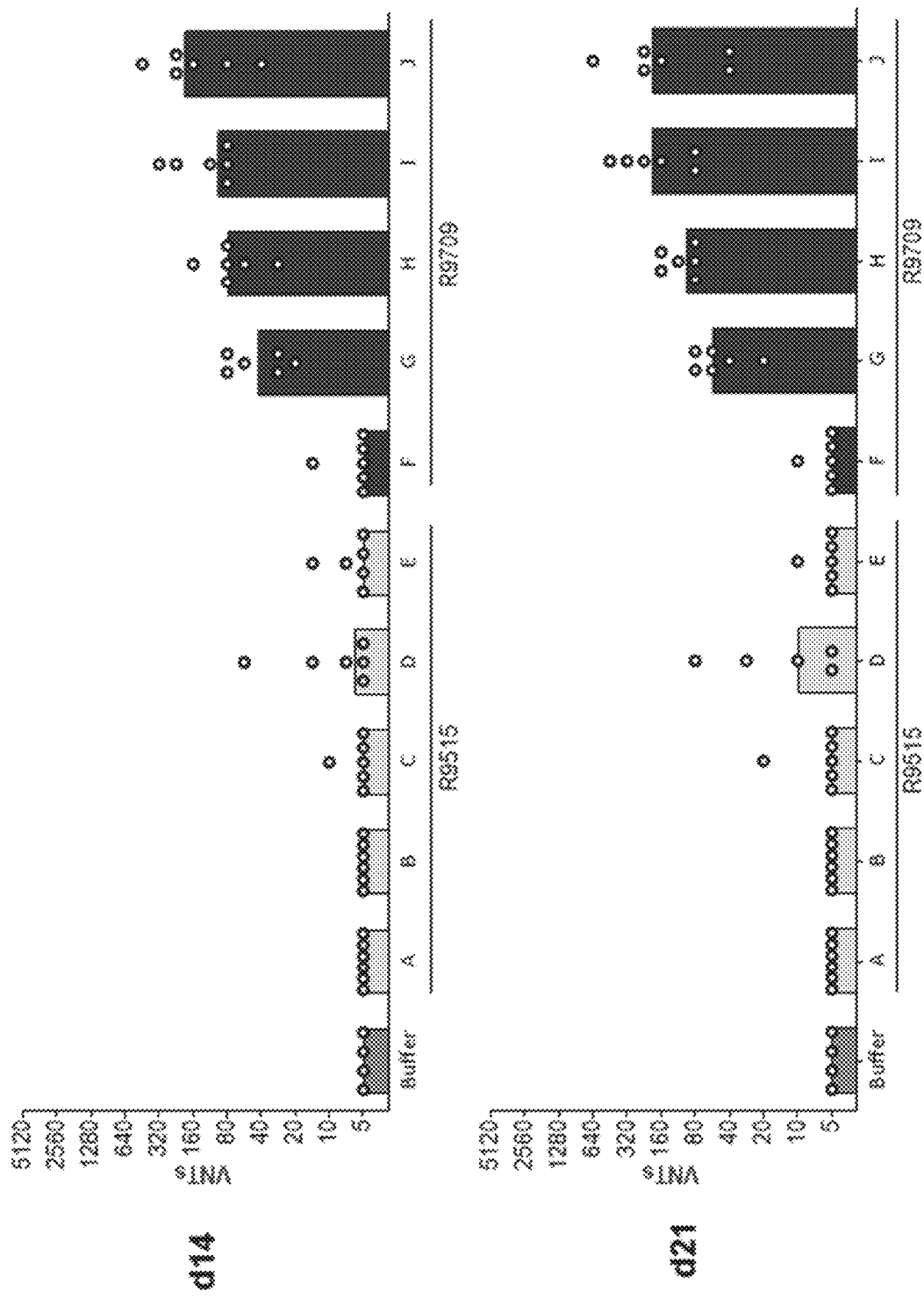
Figure 16C:
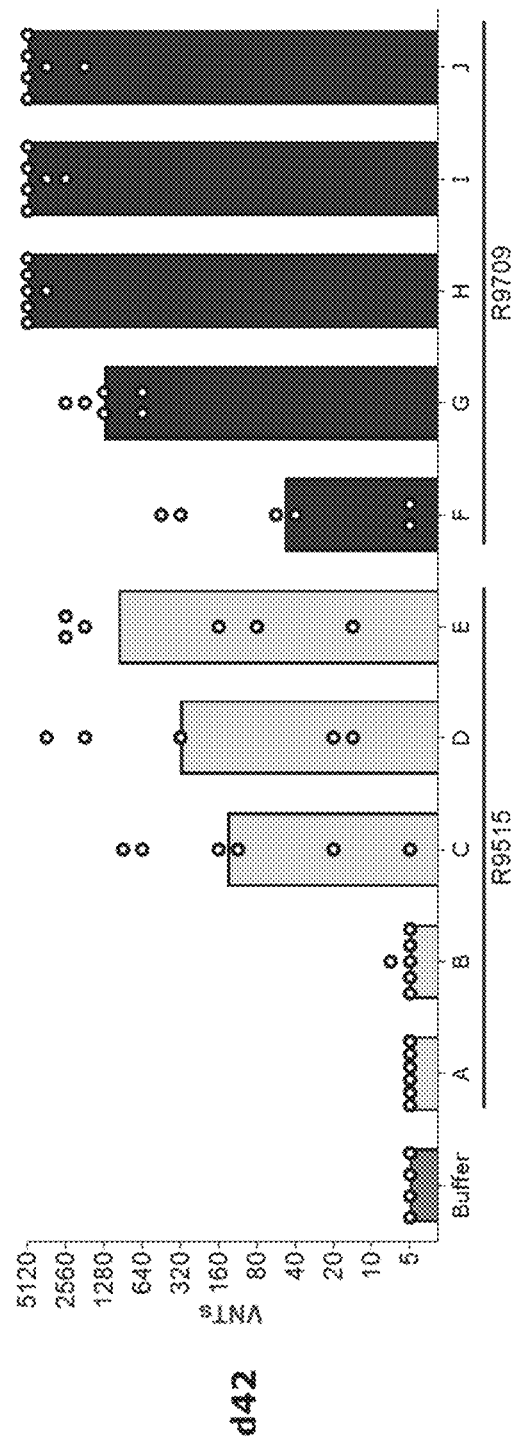

FIGS. 16A-C show significant antibody responses in rats for groups vaccinated with different doses of the mRNA vaccine encoding full length stabilized S protein (S_stab) comprising different non-coding regions formulated in LNPs. FIG. 16A shows a robust and dose-dependent induction of IgG1 and IgG2a binding antibodies and FIG. 16B the early induction of VNTs after only one dose of vaccination in a dose-dependent manner for the mRNA vaccine encoding full length stabilized S protein (S_stab) comprising the non-coding region with 3' end hSL-A100 and the UTR combination a-1 (HSD17B4/PSMB3) formulated in LNPs. FIG. 16C shows the induction of VNTs after two doses of vaccination on day 42. The experiments were performed as described in Example 14. Further construct details are provided in Table 20.

FIGS. 17A-D show that CVnCoV (mRNA vaccine encoding full length stabilized S protein (S_stab) formulated in LNPs) induces humoral response in non-human primates. (FIG. 17A) Schematic drawing of study setup. Rhesus macaques (n=6; 3 male, 3 female/group) were vaccinated IM on day 0 and day 28 with 0.5 μg or 8 μg of CVnCoV or remained unvaccinated. All animals were challenge with $5.0\times10^6$ PFU of SARS-CoV-2 on d56. Two animals of each group were terminated on d62, d63 and d64, respectively. (FIG. 17B) Trimeric Spike protein or (FIG. 17C) RBD specific binding IgG antibodies, displayed as endpoint titres at different time points as indicated. (FIG. 17D) Virus neutralising antibodies determined via focus reduction neutralisation test at different time points as indicated. All values are displayed as median with range. Dotted lines represent vaccinations and challenge infection, respectively. RBD receptor binding domain; VNT virus neutralising titre. The experiment was performed as described in Example 15. Further construct details are provided in Table 21.

FIGS. 18A-B show that CVnCoV (mRNA vaccine encoding full length stabilized S protein (S_stab) formulated in LNPs) induces cellular responses in non-human primates. PBMCs from 0.5 μg or 8 μg CVnCoV vaccinated or from untreated animals isolated at different time points were re-stimulated with S specific peptide pools ex vivo followed by IFNγ ELISpot analysis. (FIG. 18A) IFNγ ELISpot before challenge infection on d56. Panel 1 represent results of stimulation with a single peptide pool covering the whole S protein, panels 2-4 depict stimulation results of ten individual pools covering the entire S protein in each group. (FIG. 18B) IFNγ ELISpot until termination on d62-d64. Panel 1 represent results of stimulation with three mega-pools and shows the mummed response covering the whole S protein, panels 2-4 depict stimulation results of ten individual pools covering the entire S protein in each group. SFU spot forming unit; PP peptide pool. The experiment was performed as described in Example 15. Further construct details are provided in Table 21.

FIGS. 19A-F show that CVnCoV (mRNA vaccine encoding full length stabilized S protein (S_stab) formulated in LNPs) protects non-human primates from challenge infection (FIG. 19A) Nasal swabs taken at different time points post challenge (FIG. 19B) in life BAL samples taken on d59 and at termination on d62-64 and (FIG. 19C) lung tissue homogenates from d62-64 were analysed for copies of total viral RNA via RT-qPCR. (FIG. 19D) Nasal swabs taken at different time points past challenge (FIG. 19E) in life BAL samples taken on d59 and at termination on d62-64 and (FIG. 19F) lung tissue homogenates from d62-64 were analysed for copies of subgenomic viral RNA via RT-qPCR. Values are depicted as medians with range. Lower and upper dotted lines represent LLOD and LLOQ, respectively. Kruskall-Wallis ANOVA followed by Dunn's test was used to compare groups and P values are shown. LLOD lower limit of detection, LLOQ lower limit of quantification, RT-qPCR Reverse transcription-quantitative polymerase chain reaction. The experiment was performed as described in Example 15. Further construct details are provided in Table 21.

FIGS. 20A-I show that CVnCoV (mRNA vaccine encoding full length stabilized S protein (S_stab) formulated in LNPs) protects non-human primates from challenge infection (FIG. 20A) Throat swabs taken at different time points past challenge were analysed for copies of total viral RNA via RT-qPCR (FIG. 20B) Throat swabs taken at different time points past challenge analysed for copies of subgenomic RNA via RT-qPCR. Homogenised tissue derived from (FIG. 20C) tonsils (FIG. 20D) trachea (FIG. 20E) spleen (FIG. 20F) duodenum (FIG. 20G) colon (FIG. 20H) liver (FIG. 20I) kidney were analysed for copies of total viral RNA via RT-qPCR. (RT-qPCR Reverse transcription-quantitative polymerase chain reaction, sg subgenomic). The experiment was performed as described in Example 15. Further construct details are provided in Table 21.

FIGS. 21A-F Exemplary sections showing histopathology (H&E) and SARS-CoV-2 in situ hybridisation (ISH). FIG. 21A: Alveolar necrosis and inflammatory exudates (*) in the alveolar spaces and type II pneumocyte hyperplasia (arrows). FIG. 21B: Mild perivascular cuffing (arrow). FIG. 21C: Inflammatory cell infiltration in the alveolar spaces and the interalveolar septa (*) and type II pneumocyte hyperplasia (arrows). FIG. 21D: SARS-CoV-2 ISH staining in abundant cell within inflammatory foci (arrows). FIG. 21E: SARS-CoV-2 ISH staining in a single cell within an interalveolar septum (arrow). FIG. 21F: Abundant foci of SARS-CoV-2 ISH stained cells within the alveolar lining and the interalveolar septa (arrows) (Bar=100 μm. ISH in situ hybridisations). The experiment was performed as described in Example 15. Further construct details are provided in Table 21.

FIGS. 22A-D show that vaccination with 8 μg of CVnCoV (mRNA vaccine encoding full length stabilized S protein (S_stab) formulated in LNPs) protects the lungs from pathological changes upon viral challenge (FIG. 22A) Heat map showing scores for each lung pathology parameter and the average score for each animal from all groups as indicated. Severity ranges from 0 to 4: 0=none; 1=minimal; 2=mild; 3=moderate and 4=marked/severe. (FIG. 22B) Graph representing the cumulative score for all the lung histopathology parameters from each animal. (FIG. 22C) Presence of viral RNA in lung tissue sections from all animals expressed as percentage of ISH (RNAScope, in situ hybridisation) positive staining area of lung section. (FIG. 22D) Cumulative score of lung pathology detected via CT radiology. Box and whiskers indicate median with range. Kruskall-Wallis ANOVA followed by Dunn's test was used to compare groups and P values are shown. The experiment was performed as described in Example 15. Further construct details are provided in Table 21.

FIGS. 23A-C show induction of IFNa in human PBMCs (FIG. 23A) stimulated with mRNA vaccine compositions. Induction of VNTs after one vaccination only (on day 21) and after two vaccination (on day 42) is shown in FIGS. 23B and C. All of the mRNA vaccine compositions with mRNAs comprising a 3' end "hSL-A100" or "A-100" (groups C-G, I-M) showed improved, early and strong induction of VNTs. In these constructs, the poly(A) sequence is located directly at the 3' terminus of the RNA.

FIGS. 24A-B FIG. 24A shows the induction of VNTs after only one vaccination. mRNA vaccine compositions with mRNAs comprising a 3' end "hSL-A100" or "A-100" showed improved, early and strong induction of VNTs. In these constructs, the poly(A) sequence is located directly at the 3' terminus of the RNA. FIG. 24B demonstrate the induction of VNTs after only one vaccination (group A-E) or after two vaccination (group F-J) at a later timepoint on day 42. mRNA vaccine composition comprising R9709 (group B) induced most prominent titers of VNTs between the groups receiving only one vaccination.

EXAMPLES

In the following, particular examples illustrating various embodiments and aspects of the invention are presented. However, the present invention shall not to be limited in scope by the specific embodiments described herein. The following preparations and examples are given to enable those skilled in the art to more clearly understand and to practice the present invention. The present invention, however, is not limited in scope by the exemplified embodiments, which are intended as illustrations of single aspects of the invention only, and methods, which are functionally equivalent are within the scope of the invention. Indeed, various modifications of the invention in addition to those described herein will become readily apparent to those skilled in the art from the foregoing description, accompanying figures and the examples below. All such modifications fall within the scope of the appended claims.

Example 1: Preparation of DNA and RNA Constructs, Compositions, and Vaccines The present Example provides methods of obtaining the RNA of the invention as well as methods of generating a composition or a vaccine of the invention.

1.1. Preparation of DNA and RNA Constructs

DNA sequences encoding different SARS-CoV-2 S protein designs were prepared and used for subsequent RNA in vitro transcription reactions. Said DNA sequences were prepared by modifying the wild type or reference encoding DNA sequences by introducing a G/C optimized or modified coding sequence (e.g., "cds opt1") for stabilization and expression optimization. Sequences were introduced into a pUC derived DNA vector to comprise stabilizing 3'-UTR sequences and 5'-UTR sequences, additionally comprising a stretch of adenosines (e.g. A64 or A100), and optionally a histone-stem-loop (hSL) structure, and optionally a stretch of 30 cytosines (e.g. C30) (see Table 4, for an overview of coronavirus antigen designs see List 1 or Table 1).

The obtained plasmid DNA constructs were transformed and propagated in bacteria using common protocols known in the art. Eventually, the plasmid DNA constructs were extracted, purified, and used for subsequent RNA in vitro transcription (see section 1.2).

Alternatively, DNA plasmids can be used as template for PCR-amplification (see section 1.3).

1.2. RNA In Vitro Transcription from Plasmid DNA Templates

DNA plasmids prepared according to section 1.1 were enzymatically linearized using a restriction enzyme and used for DNA dependent RNA in vitro transcription using T7 RNA polymerase in the presence of a nucleotide mixture (ATP/GTP/CTP/UTP) and cap analog (e.g. m7GpppG, m7G(5')ppp(5')(2'OMeA)pG, m7G(5')ppp(5')(2'OMeG)pG), or 3'OMe-m7G(5')ppp(5')(2'OMeA)pG) under suitable buffer conditions. The obtained RNA constructs were purified using RP-HPLC (PureMessenger®, CureVac AG, TObingen, Germany; WO2008/077592) and used for in vitro and in vivo experiments. DNA templates may also be generated using PCR. Such PCR templates can be used for DNA dependent RNA in vitro transcription using an RNA polymerase as outlined herein.

To obtain chemically modified mRNA, RNA in vitro transcription was performed in the presence of a modified nucleotide mixture comprising pseudouridine N(1)-methylpseudouridine (m1ψ) instead of uracil. The obtained ml P chemically modified RNA was purified using RP-HPLC (PureMessenger®, CureVac AG, TObingen, Germany; WO2008/077592) and used for further experiments (see e.g. Example 16 or 17).

Generation of Capped RNA Using Enzymatic Capping (Prophetic):

Some RNA constructs are in vitro transcribed in the absence of a cap analog. The cap-structure (cap0 or cap1) is then added enzymatically using capping enzymes as commonly known in the art. In short, in vitro transcribed RNA is capped using a capping kit to obtain cap0-RNA. cap0-RNA is additionally modified using cap specific 2'-O-methyltransferase to obtain cap1-RNA. cap1-RNA is purified e.g. as explained above and used for further experiments.

RNA for clinical development is produced under current good manufacturing practice e.g. according to WO2016/180430, implementing various quality control steps on DNA and RNA level.

The RNA Constructs of the Examples:

The generated RNA sequences/constructs are provided in Table 4 with the encoded antigenic protein and the respective UTR elements indicated therein. If not indicated otherwise, the RNA sequences/constructs of Table 4 have been produced using RNA in vitro transcription in the presence of a m7GpppG, m7G(5')ppp(5')(2'OMeA)pG; accordingly, the RNA sequences/constructs comprise a 5' Cap1 structure. If not indicated otherwise, the RNA sequences/constructs of Table 4 have been produced in the absence of chemically modified nucleotides (e.g. pseudouridine (ψ) or N(1)-methylpseudouridine (m1ψ)).

1.3. RNA In Vitro Transcription from PCR Amplified DNA Templates (Prophetic):

Purified PCR amplified DNA templates prepared according to paragraph 1.1 is transcribed in vitro using DNA dependent T7 RNA polymerase in the presence of a nucleotide mixture (ATP/GTP/CTP/UTP) and cap analog (m7GpppG or 3'-O-Me-m7G(5')ppp(5')G)) under suitable buffer conditions. Alternatively, PCR amplified DNA is transcribed in vitro using DNA dependent T7 RNA polymerase in the presence of a modified nucleotide mixture (ATP, GTP, CTP, N1-methylpseudouridine (m1ψ) or pseudouridine (ψ) and cap analogue (m7GpppG, m7G(5')ppp(5')(2'OMeA)pG or m7G(5')ppp(5')(2'OMeG)pG) under suitable buffer conditions. Some RNA constructs are in vitro transcribed in the absence of a cap analog and the cap-structure (cap0 or cap1) is added enzymatically using capping enzymes as commonly known in the art. The obtained RNA is purified e.g. as explained above and used for further experiments. The obtained mRNAs are purified e.g. using RP-HPLC (PureMessenger®, CureVac AG, Tübingen, Germany; WO2008/077592) and used for in vitro and in vivo experiments.

TABLE 4

RNA constructs encoding different SARS-CoV-2 S antigen designs

| RNA ID | Name | Short name | CDS opt. | 5'-UTR/ 3'-UTR; UTR Design | 3'-end | SEQ ID NO: Protein | SEQ ID NO: CDS | SEQ ID NO: RNA |
|---|---|---|---|---|---|---|---|---|
| R9488, R9492, R10161* | Spike protein | S | opt1 (gc) | HSD17B4/ PSMB3; a-1 | hSL-A100 | 1 | 136 | 148 |
| R9514 | Spike protein | S | opt1 (gc) | —/muag; i-3 | A64-N5-C30-hSL-N5 | 1 | 136 | 162 |
| R9487, R9491, R9709, R10159**, R10160* | Spike pre-fusion stabilized protein | S_stab_PP (K986P_V987P) | opt1 (gc) | HSD17B4/ PSMB3; a-1 | hSL-A100 | 10 | 137 | 149 |
| R9515, R10157** | Spike pre-fusion stabilized protein | S_stab_PP (K986P_V987P) | opt1 (gc) | —/muag; i-3 | A64-N5-C30-hSL-N5 | 10 | 137 | 163 |
| R9486, R9490 | Spike pre-fusion stabilized protein | S_stab_PP (K986P_V987P) | opt3 (human) | HSD17B4/ PSMB3; a-1 | hSL-A100 | 10 | 142 | 150 |
| R9517 | Spike pre-fusion stabilized protein | S_stab_PP (K986P_V987P) | opt3 (human) | —/muag; i-3 | A64-N5-C30-hSL-N5 | 10 | 142 | 164 |
| R9519 | Spike pre-fusion stabilized protein | S_stab_PP (K986P_V987P) | opt10 (gc mod) | —/muag; i-3 | A64-N5-C30-hSL-N5 | 10 | 146 | 165 |
| R9489, R9493 | S fragment (1-681) spike protein | S1 | opt1 (gc) | HSD17B4/ PSMB3; a-1 | hSL-A100 | 27 | 138 | 152 |
| R9506, R9513 | S fragment (1-681) spike protein | S1 | opt1 (gc) | —/muag; i-3 | A64-N5-C30-hSL-N5 | 27 | 138 | 166 |
| R9516 | S fragment (1-681) spike protein | S1 | opt3 (human) | —/muag; i-3 | A64-N5-C30-hSL-N5 | 27 | 143 | 167 |
| R9518 | S fragment (1-681) spike protein | S1 | opt10 (gc mod) | —/muag; i-3 | A64-N5-C30-hSL-N5 | 27 | 147 | 168 |
| R9561 | Spike pre-fusion stabilized protein | S_stab_disul (P715C_P1069C) | opt1 (gc) | —/muag; i-3 | A64-N5-C30-hSL-N5 | 21 | 11804 | 12816 |
| R9564 | Spike pre-fusion stabilized protein | S_stab_disul (G889C_L1034C) | opt1 (gc) | —/muag; i-3 | A64-N5-C30-hSL-N5 | 22 | 11805 | 12817 |
| R9562 | Spike pre-fusion stabilized protein | S_stab_disul (F970C_G999C) | opt1 (gc) | —/muag; i-3 | A64-N5-C30-hSL-N5 | 25 | 11808 | 12820 |
| R9560 | Spike pre-fusion stabilized protein | S_stab_disul (A890C_V1040C) | opt1 (gc) | —/muag; i-3 | A64-N5-C30-hSL-N5 | 1145 | 11810 | 12822 |
| R9563 | Spike pre-fusion stabilized protein | S_stab_disul (T874C_S1055C) | opt1 (gc) | —/muag; i-3 | A64-N5-C30-hSL-N5 | 1212 | 11811 | 12823 |
| R9641 | Spike pre-fusion stabilized protein | S_stab_PP_cav (K986P_V987P_ T887W_A1020W) | opt1 (gc) | —/muag; i-3 | A64-N5-C30-hSL-N5 | 408 | 11799 | 12811 |
| R9660 | Spike pre-fusion stabilized protein | S_stab_PP_cav (K986P_V987P_ P1069F) | opt1 (gc) | —/muag; i-3 | A64-N5-C30-hSL-N5 | 475 | 11800 | 12812 |
| R9661 | Spike pre-fusion | S_stab_PP_prot (K986P_V987P_ | opt1 (gc) | —/muag; i-3 | A64-N5-C30-hSL- | 542 | 11801 | 12813 |

TABLE 4-continued

RNA constructs encoding different SARS-CoV-2 S antigen designs

| RNA ID | Name | Short name | CDS opt. | 5'-UTR/ 3'-UTR; UTR Design | 3'-end | SEQ ID NO: Protein | SEQ ID NO: CDS | SEQ ID NO: RNA |
|---|---|---|---|---|---|---|---|---|
| | stabilized protein | H1048Q_H1064N_ H1083N_H1101N) | | | N5 | | | |
| R9663 | Spike pre-fusion stabilized protein | S_stab_PP_ delTMflex_WhcAg (K986P_V987P) | opt1 (gc) | —/muag; i-3 | A64-N5-C30-hSL-N5 | 10726 | 11953 | 12931 |
| R9664 | Spike pre-fusion stabilized protein | S_stab_PP_ delTMflex_Ferritin (K986P_V987P) | opt1 (gc) | —/muag; i-3 | A64-N5-C30-hSL-N5 | 8716 | 11923 | 12901 |
| R9848 | Spike pre-fusion stabilized protein | S_stab_PP_hex (K986P_V987P_ F817P_A892P_ A899P_A942P) | opt1 (gc) | —/muag; i-3 | A64-N5-C30-hSL-N5 | 22732 | 22759 | 22813 |
| R9926 | RBD fragment (334-528) spike protein | RBD_Foldon | opt1 (gc) | —/muag; i-3 | A64-N5-C30-hSL-N5 | 22734 | 22761 | 22815 |
| R9927 | RBD fragment (334-528) spike protein | RBD_Foldon | opt1 (gc) | HSD17B4/ PSMB3; a-1 | hSL-A100 | 22734 | 22761 | 22788 |
| R10335 | RBD fragment (334-528) spike protein | RBD_LumSynth | opt1 (gc) | —/muag; i-3 | A64-N5-C30-hSL-N5 | 22735 | 22762 | 22816 |
| R10338 | RBD fragment (334-528) spike protein | RBD_LumSynth | opt1 (gc) | HSD17B4/ PSMB3; a-1 | hSL-A100 | 22735 | 22762 | 22789 |
| R10336 | RBD fragment (334-528) spike protein | LumSynth_RBD | opt1 (gc) | —/muag; i-3 | A64-N5-C30-hSL-N5 | 22736 | 22763 | 22817 |
| R10339 | RBD fragment (334-528) spike protein | LumSynth_RBD | opt1 (gc) | HSD17B4/ PSMB3; a-1 | hSL-A100 | 22736 | 22763 | 22790 |
| R10337 | RBD fragment (334-528) spike protein | RBD_Ferritin | opt1 (gc) | —/muag; i-3 | A64-N5-C30-hSL-N5 | 22733 | 22760 | 22814 |
| R10340 | RBD fragment (334-528) spike protein | RBD_Ferritin | opt1 (gc) | HSD17B4/ PSMB3; a-1 | hSL-A100 | 22733 | 22760 | 22787 |
| R10182 | S(D614G) | S (D614G) | opt1 (gc) | HSD17B4/ PSMB3; a-1 | hSL-A100 | 22737 | 22764 | 22791 |
| R10165 | Spike pre-fusion stabilized protein | S_stab_PP (K986P_V987P_ D614G) | opt1 (gc) | —/muag; i-3 | A64-N5-C30-hSL-N5 | 22738 | 22765 | 22819 |
| R10166 | Spike pre-fusion stabilized protein | S_stab_PP (K986P_V987P_ D614G) | opt1 (gc) | HSD17B4/ PSMB3; a-1 | hSL-A100 | 22738 | 22765 | 22792 |
| R10276 | Spike protein | S (A222V_D614G) | opt1 (gc) | —/muag; i-3 | A64-N5-C30-hSL-N5 | 22739 | 22766 | 22820 |
| R10278 | Spike protein | S (A222V_D614G) | opt1 (gc) | HSD17B4/ PSMB3; a-1 | hSL-A100 | 22739 | 22766 | 22793 |
| R10277 | Spike pre-fusion | S_stab_PP (K986P_V987P_ | opt1 (gc) | —/muag; i-3 | A64-N5-C30-hSL- | 22740 | 22767 | 22821 |

TABLE 4-continued

RNA constructs encoding different SARS-CoV-2 S antigen designs

| RNA ID | Name | Short name | CDS opt. | 5'-UTR/ 3'-UTR; UTR Design | 3'-end | SEQ ID NO: Protein | SEQ ID NO: CDS | SEQ ID NO: RNA |
|---|---|---|---|---|---|---|---|---|
| | stabilized protein | A222V_D614G) | | | N5 | | | |
| R10279 | Spike pre-fusion stabilized protein | S_stab_PP (K986P_V987P_ A222V_D614G) | opt1 (gc) | HSD17B4/ PSMB3; a-1 | hSL-A100 | 22740 | 22767 | 22794 |
| R10296 | Spike protein | S (N439K_D614G) | opt1 (gc) | —/muag; i-3 | A64-N5-C30-hSL-N5 | 22741 | 22768 | 22822 |
| R10298 | Spike protein | S (N439K_D614G) | opt1 (gc) | HSD17B4/ PSMB3; a-1 | hSL-A100 | 22741 | 22768 | 22795 |
| R10297 | Spike pre-fusion stabilized protein | S_stab_PP (K986P_V987P_ N439K_D614G) | opt1 (gc) | —/muag; i-3 | A64-N5-C30-hSL-N5 | 22742 | 22769 | 22823 |
| R10299 | Spike pre-fusion stabilized protein | S_stab_PP (K986P_V987P_ N439K_D614G) | opt1 (gc) | HSD17B4/ PSMB3; a-1 | hSL-A100 | 22742 | 22769 | 22796 |
| R10284 | Spike protein | S (S477N_D614G) | opt1 (gc) | —/muag; i-3 | A64-N5-C30-hSL-N5 | 22743 | 22770 | 22824 |
| R10287 | Spike protein | S (S477N_D614G) | opt1 (gc) | HSD17B4/ PSMB3; a-1 | hSL-A100 | 22743 | 22770 | 22797 |
| R10285 | Spike pre-fusion stabilized protein | S_stab_PP (K986P_V987P_ S477N_D614G) | opt1 (gc) | —/muag; i-3 | A64-N5-C30-hSL-N5 | 22744 | 22771 | 22825 |
| R10286 | Spike pre-fusion stabilized protein | S_stab_PP (K986P_V987P_ S477N_D614G) | opt1 (gc) | HSD17B4/ PSMB3; a-1 | hSL-A100 | 22744 | 22771 | 22798 |
| R10350 | Spike protein | S (N501Y_D614G) | opt1 (gc) | —/muag; i-3 | A64-N5-C30-hSL-N5 | 22745 | 22772 | 22826 |
| R10351 | Spike pre-fusion stabilized protein | S_stab_PP (K986P_V987P_ N501Y_D614G) | opt1 (gc) | —/muag; i-3 | A64-N5-C30-hSL-N5 | 22746 | 22773 | 22827 |
| R10272 | Spike protein | S (H69del_V70del_ D614G) | opt1 (gc) | —/muag; i-3 | A64-N5-C30-hSL-N5 | 22747 | 22774 | 22828 |
| R10274 | Spike protein | S (H69del_V70del_ D614G) | opt1 (gc) | HSD17B4/ PSMB3; a-1 | hSL-A100 | 22747 | 22774 | 22801 |
| R10273 | Spike pre-fusion stabilized protein | S_stab_PP (K986P_V987P_ H69del_V70del_ D614G) | opt1 (gc) | —/muag; i-3 | A64-N5-C30-hSL-N5 | 22748 | 22775 | 22829 |
| R10275 | Spike pre-fusion stabilized protein | S_stab_PP (K986P_V987P_ H69del_V70del_ D614G) | opt1 (gc) | HSD17B4/ PSMB3; a-1 | hSL-A100 | 22748 | 22775 | 22802 |
| R10280 | Spike protein | S (Y453F_D614G) | opt1 (gc) | —/muag; i-3 | A64-N5-C30-hSL-N5 | 22749 | 22776 | 22830 |
| R10282 | Spike protein | S (Y453F_D614G) | opt1 (gc) | HSD17B4/ PSMB3; a-1 | hSL-A100 | 22749 | 22776 | 22803 |
| R10281 | Spike pre-fusion stabilized protein | S_stab_PP (K986P_V987P_ Y453F_D614G) | opt1 (gc) | —/muag; i-3 | A64-N5-C30-hSL-N5 | 22750 | 22777 | 22831 |
| R10283 | Spike pre-fusion stabilized protein | S_stab_PP (K986P_V987P_ Y453F_D614G) | opt1 (gc) | HSD17B4/ PSMB3; a-1 | hSL-A100 | 22750 | 22777 | 22804 |
| R10288 | Spike protein | S (D614G_I692V) | opt1 (gc) | —/muag; i-3 | A64-N5-C30-hSL-N5 | 22751 | 22778 | 22832 |

TABLE 4-continued

RNA constructs encoding different SARS-CoV-2 S antigen designs

| RNA ID | Name | Short name | CDS opt. | 5'-UTR/ 3'-UTR; UTR Design | 3'-end | SEQ ID NO: Protein | SEQ ID NO: CDS | SEQ ID NO: RNA |
|---|---|---|---|---|---|---|---|---|
| R10290 | Spike protein | S (D614G__I692V) | opt1 (gc) | HSD17B4/ PSMB3; a-1 | hSL-A100 | 22751 | 22778 | 22805 |
| R10289 | Spike pre-fusion stabilized protein | S_stab_PP (K986P__V987P__ D614G__I692V) | opt1 (gc) | —/muag; i-3 | A64-N5-C30-hSL-N5 | 22752 | 22779 | 22833 |
| R10291 | Spike pre-fusion stabilized protein | S_stab_PP (K986P__V987P__ D614G__I692V) | opt1 (gc) | HSD17B4/ PSMB3; a-1 | hSL-A100 | 22752 | 22779 | 22806 |
| R10344 | Spike protein | S (D614G__M1229I) | opt1 (gc) | —/muag; i-3 | A64-N5-C30-hSL-N5 | 22753 | 22780 | 22834 |
| R10345 | Spike pre-fusion stabilized protein | S_stab_PP (K986P__V987P__ D614G__M1229I) | opt1 (gc) | —/muag; i-3 | A64-N5-C30-hSL-N5 | 22754 | 22781 | 22835 |
| R10292 | Spike protein | S (H69del__V70del__ A222V__Y453F__ S477N__D614G__ I692V) | opt1 (gc) | —/muag; i-3 | A64-N5-C30-hSL-N5 | 22755 | 22782 | 22836 |
| R10294 | Spike protein | S (H69del__V70del__ A222V__Y453F__ S477N__D614G__ I692V) | opt1 (gc) | HSD17B4/ PSMB3; a-1 | hSL-A100 | 22755 | 22782 | 22809 |
| R10293 | Spike pre-fusion stabilized protein | S_stab_PP (K986P__V987P__ H69del__V70del__ A222V__Y453F__ S477N__D614G__ I692V) | opt1 (gc) | —/muag; i-3 | A64-N5-C30-hSL-N5 | 22756 | 22783 | 22837 |
| R10295 | Spike pre-fusion stabilized protein | S_stab_PP (K986P__V987P__ H69del__V70del__ A222V__Y453F__ S477N__D614G__ I692V) | opt1 (gc) | HSD17B4/ PSMB3; a-1 | hSL-A100 | 22756 | 22783 | 22810 |
| R10346 | Spike protein | S (H69del__V70del__ Y453F__D614G__ I692V__M1229I) | opt1 (gc) | —/muag; i-3 | A64-N5-C30-hSL-N5 | 22757 | 22784 | 22838 |
| R10347 | Spike pre-fusion stabilized protein | S_stab_PP (K986P__V987P__ H69del__V70del__ Y453F__D614G__ I692V__M1229I) | opt1 (gc) | —/muag; i-3 | A64-N5-C30-hSL-N5 | 22758 | 22785 | 22839 |
| R10136, R10158** | Spike pre-fusion stabilized protein | S_stab_PP (K986P__V987P) | opt1 (gc) | —/muag; i-3 | hSL-A100 | 10 | 137 | 24397 |
| R10154 | Spike pre-fusion stabilized protein | S_stab_PP (K986P__V987P) | opt1 (gc) | —/muag; i-3 | A100 | 10 | 137 | 25717 |
| R10153 | Spike pre-fusion stabilized protein | S_stab_PP (K986P__V987P) | opt1 (gc) | HSD17B4/ PSMB3; a-1 | A100 | 10 | 137 | 24837 |
| R10155 | Spike pre-fusion stabilized protein | S_stab_PP (K986P__V987P) | opt1 (gc) | Rpl31/ RPS9; e-2 | hSL-A100 | 10 | 137 | 23957 |
| R10156 | Spike pre-fusion stabilized protein | S_stab_PP (K986P__V987P) | opt1 (gc) | Rpl31/ RPS9; e-2 | A100 | 10 | 137 | 25277 |
| R10183 | Spike pre-fusion stabilized protein | S_stab_PP (K986P__V987P) | opt1 (gc) | Slc7a3/ PSMB3; a-3 | hSL-A100 | 10 | 137 | 23737 |

TABLE 4-continued

RNA constructs encoding different SARS-CoV-2 S antigen designs

| RNA ID | Name | Short name | CDS opt. | 5'-UTR/ 3'-UTR; UTR Design | 3'-end | SEQ ID NO: Protein | SEQ ID NO: CDS | SEQ ID NO: RNA |
|---|---|---|---|---|---|---|---|---|
| R10184 | Spike pre-fusion stabilized protein | S_stab_PP (K986P_V987P) | opt1 (gc) | Slc7a3/ PSMB3; a-3 | A100 | 10 | 137 | 25057 |
| R10300 | Spike pre-fusion stabilized protein | S_stab_PP (K986P_V987P) | opt1 (gc) | HSD17B4/ PSMB3; a-1 | hSL-A25 | 10 | 137 | 26925 |
| R10301 | Spike pre-fusion stabilized protein | S_stab_PP (K986P_V987P) | opt1 (gc) | HSD17B4/ PSMB3; a-1 | hSL-A60 | 10 | 137 | 26926 |
| R10302 | Spike pre-fusion stabilized protein | S_stab_PP (K986P_V987P) | opt1 (gc) | HSD17B4/ PSMB3; a-1 | hSL-A80 | 10 | 137 | 26927 |
| R10303 | Spike pre-fusion stabilized protein | S_stab_PP (K986P_V987P) | opt1 (gc) | HSD17B4/ PSMB3; a-1 | hSL-A90 | 10 | 137 | 26928 |
| R10304 | Spike pre-fusion stabilized protein | S_stab_PP (K986P_V987P) | opt1 (gc) | HSD17B4/ PSMB3; a-1 | hSL-A110 | 10 | 137 | 26929 |
| R10305 | Spike pre-fusion stabilized protein | S_stab_PP (K986P_V987P) | opt1 (gc) | HSD17B4/ PSMB3; a-1 | hSL-A120 | 10 | 137 | 26930 |
| R10306 | Spike pre-fusion stabilized protein | S_stab_PP (K986P_V987P) | opt1 (gc) | HSD17B4/ PSMB3; a-1 | hSL-A140 | 10 | 137 | 26931 |
| R10307 | Spike pre-fusion stabilized protein | S_stab_PP (K986P_V987P) | opt1 (gc) | HSD17B4/ PSMB3; a-1 | hSL | 10 | 137 | 26932 |
| R10308 | Spike pre-fusion stabilized protein | S_stab_PP (K986P_V987P) | opt1 (gc) | —/muag; i-3 | A50-N5-C30-hSL-N5 | 10 | 137 | 26933 |
| R10309 | Spike pre-fusion stabilized protein | S_stab_PP (K986P_V987P) | opt1 (gc) | —/muag; i-3 | A35-N5-C30-hSL-N5 | 10 | 137 | 26934 |
| R10310 | Spike pre-fusion stabilized protein | S_stab_PP (K986P_V987P) | opt1 (gc) | —/muag; i-3 | A25-N5-C30-hSL-N5 | 10 | 137 | 26935 |
| R10311 | Spike pre-fusion stabilized protein | S_stab_PP (K986P_V987P) | opt1 (gc) | —/muag; i-3 | A73-N5-C30-hSL-N5 | 10 | 137 | 26936 |
| R10312 | Spike pre-fusion stabilized protein | S_stab_PP (K986P_V987P) | opt1 (gc) | —/muag; i-3 | hSL-N5 | 10 | 137 | 26937 |
| R10162** | Spike pre-fusion stabilized protein | S_stab_PP (K986P_V987P) | opt10 (gc mod) | HSD17B4/ PSMB3; a-1 | hSL-A100 | 10 | 146 | 151 |
| R10352 | Spike protein | S (H69del_V70del_ Y144del_N501Y_ A570D_D614G_ P681H_T716I_ S982A_D1118H) | opt1 (gc) | —/muag; i-3 | A64-N5-C30-hSL-N5 | 22941 | 22981 | 23201 |
| R10356 | Spike protein | S (H69del_V70del_ Y144del_N501Y_ A570D_D614G_ P681H_T716I_ S982A_D1118H) | opt1 (gc) | HSD17B4/ PSMB3; a-1 | hSL-A100 | 22941 | 22981 | 23421 |

TABLE 4-continued

RNA constructs encoding different SARS-CoV-2 S antigen designs

| RNA ID | Name | Short name | CDS opt. | 5'-UTR/ 3'-UTR; UTR Design | 3'-end | SEQ ID NO: Protein | SEQ ID NO: CDS | SEQ ID NO: RNA |
|---|---|---|---|---|---|---|---|---|
| R10353 | Spike prefusion stabilized protein | S_stab_PP (K986P_V987P_ H69del_V70del_ Y144del_N501Y_ A570D_D614G_ P681H_T716I_ S982A_D1118H) | opt1 (gc) | —/muag; i-3 | A64-N5-C30-hSL-N5 | 22959 | 23089 | 23309 |
| R10357 | Spike prefusion stabilized protein | S_stab_PP (K986P_V987P_ H69del_V70del_ Y144del_N501Y_ A570D_D614G_ P681H_T716I_ S982A_D1118H) | opt1 (gc) | HSD17B4/ PSMB3; a-1 | hSL-A100 | 22959 | 23089 | 23529 |
| R10358 | Spike protein | S (K417N_E484K_ N501Y_D614G) | opt1 (gc) | —/muag; i-3 | A64-N5-C30-hSL-N5 | 22942 | 22982 | 23202 |
| R10359 | Spike protein | S (K417N_E484K_ N501Y_D614G) | opt1 (gc) | HSD17B4/ PSMB3; a-1 | hSL-A100 | 22942 | 22982 | 23422 |
| R10360 | Spike prefusion stabilized protein | S_stab_PP (K986P_V987P_ K417N_E484K_ N501Y_D614G) | opt1 (gc) | —/muag; i-3 | A64-N5-C30-hSL-N5 | 22960 | 23090 | 23310 |
| R10361 | Spike prefusion stabilized protein | S_stab_PP (K986P_V987P_ K417N_E484K_ N501Y_D614G) | opt1 (gc) | HSD17B4/ PSMB3; a-1 | hSL-A100 | 22960 | 23090 | 23530 |
| R10379 | Spike prefusion stabilized protein | S_stab_PP (K986P_V987P_ L18F_D80A_ D215G_L242del_ A243del_L244del_ R246I_K417N_ E484K_N501Y_ D614G_A701V) | opt1 (gc) | —/muag; i-3 | A64-N5-C30-hSL-N5 | 22961 | 23091 | 23311 |
| R10384 | Spike prefusion stabilized protein | S_stab_PP (K986P_V987P_ L18F_D80A_ D215G_L242del_ A243del_L244del_ R246I_K417N_ E484K_N501Y_ D614G_A701V) | opt1 (gc) | HSD17B4/ PSMB3; a-1 | hSL-A100 | 22961 | 23091 | 23531 |
| R10378 | Spike prefusion stabilized protein | S_stab_PP (K986_PV987P_ E484K_D614G) | opt1 (gc) | —/muag; i-3 | A64-N5-C30-hSL-N5 | 22962 | 23092 | 23312 |
| R10380 | Spike prefusion stabilized protein | S_stab_PP (K986P_V987P_ L18F_T20N_ P26S_D138Y_ R190S_K417T_ E484K_N501Y_ D614G_H655Y_ T1027I) | opt1 (gc) | —/muag; i-3 | A64-N5-C30-hSL-N5 | 22963 | 23093 | 23313 |
| R10385 | Spike prefusion stabilized protein | S_stab_PP (K986P_V987P_ L18F_T20N_ P26S_D138Y_ R190S_K417T_ E484K_N501Y_ D614G_H655Y_ T1027I) | opt1 (gc) | HSD17B4/ PSMB3; a-1 | hSL-A100 | 22963 | 23093 | 23533 |
| R10381 | Spike prefusion stabilized protein | S_stab_PP (K986P_V987P_ S13I_W152C_ L452R_D614G) | opt1 (gc) | —/muag; i-3 | A64-N5-C30-hSL-N5 | 22964 | 23094 | 23314 |

*mRNA R10160 and R10161 were produced with 3'OME Clean Cap.
**mRNA R10157, R10158, R10159, R10162 were produced with N(1)-methylpseudouridine (m1ψ)

1.4. Preparation of an LNP Formulated mRNA Composition:

LNPs were prepared using cationic lipids, structural lipids, a PEG-lipids, and cholesterol. Lipid solution (in ethanol) was mixed with RNA solution (aqueous buffer) using a microfluidic mixing device. Obtained LNPs were re-buffered in a carbohydrate buffer via dialysis, and up-concentrated to a target concentration using ultracentrifugation tubes. LNP-formulated mRNA was stored at −80° C. prior to use in in vitro or in vivo experiments.

Preferably, lipid nanoparticles were prepared and tested according to the general procedures described in POT Pub. Nos. WO 2015/199952, WO 2017/004143 and WO 2017/075531, the full disclosures of which are incorporated herein by reference. Lipid nanoparticle (LNP)-formulated mRNA was prepared using an ionizable amino lipid (cationic lipid), phospholipid, cholesterol and a PEGylated lipid. LNPs were prepared as follows. Cationic lipid according to formula III-3 (ALC-0315), DSPC, cholesterol and PEG-lipid according to formula IVa (ALC-0159) were solubilized in ethanol at a molar ratio of approximately 47.5:10:40.8:1.7 (see Table A). Lipid nanoparticles (LNP) comprising compound III-3 were prepared at a ratio of mRNA (sequences see Table 4) to Total Lipid of 0.03-0.04 w/w. Briefly, the mRNA was diluted to 0.05 to 0.2 mg/mL in 10 to 50 mM citrate buffer, pH 4. Syringe pumps were used to mix the ethanolic lipid solution with the mRNA aqueous solution at a ratio of about 1:5 to 1:3 (vol/vol) with total flow rates above 15 ml/min. The ethanol was then removed and the external buffer replaced with PBS by dialysis. Finally, the lipid nanoparticles were filtered through a 0.2 μm pore sterile filter. Lipid nanoparticle particle diameter size was 60-90 nm as determined by quasi-elastic light scattering using a Malvern Zetasizer Nano (Malvern, UK).

TABLE A

Lipid-based carrier composition of the examples

| | Compounds | Ratio (mol %) | Structure | Mass |
|---|---|---|---|---|
| 1 | Cholesterol | 40.9 | 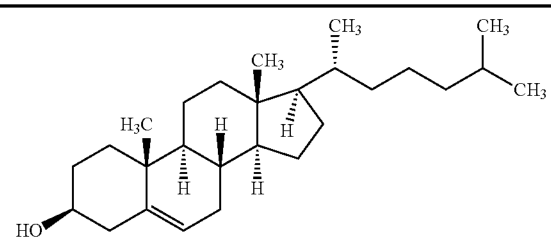 | 386.4 |
| 2 | 1,2-distearoyl-sn-glycero-3-phosphocholine (DSPC) | 10 | 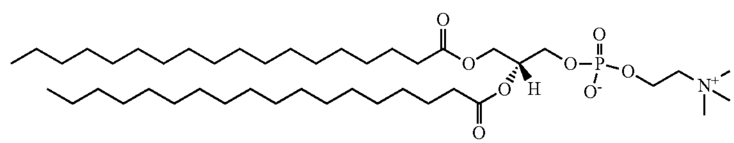 [SMILES: CCCCCCCCCCCCCCCCCC(=O)OC[C@H](COP(=O)([O-])OCC[N+](C)(C)C)OC(=O)CCCCCCCCCCCCCCCCC] | 789.6 |
| 3 | Cationic Lipid | 47.4 | 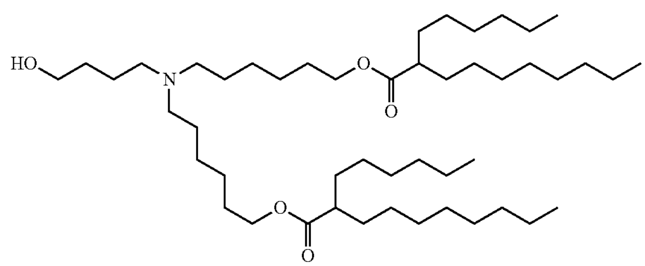 [SMILES: CCCCCCCCC(CCCCCC)C(=O)OCCCCCCN(CCCCO)CCCCCCOC(=O)C(CCCCCC)CCCCCCCC] | 765.7 |
| 4 | PEG Lipid | 1.7 | Average n = ~49 | 2010.1 |

1.5. Preparation of a Protamine Complexed mRNA Composition (Prophetic):

RNA constructs are complexed with protamine prior to use in in vivo immunization experiments. The RNA formulation consists of a mixture of 50% free RNA and 50% RNA complexed with protamine at a weight ratio of 2:1. First, mRNA is complexed with protamine by addition of protamine-Ringer's lactate solution to mRNA. After incubation for 10 minutes, when the complexes are stably generated, free mRNA is added, and the final concentration is adjusted with Ringer's lactate solution.

1.6. Expression Analysis of Designed mRNA Constructs:

The mRNA constructs as shown in Table 4 were tested for their expression via in vitro translation using Rabbit Reticulocte Lysate System as well as in cell culture followed by detection via western blot, or FACS analysis as commonly known in the art (see for further details and exemplary results Example 2).

Example 2a: Expression Analysis of mRNA Constructs Encoding SARS-CoV-2 Proteins (S, S_Stab, S1

Figure 2:
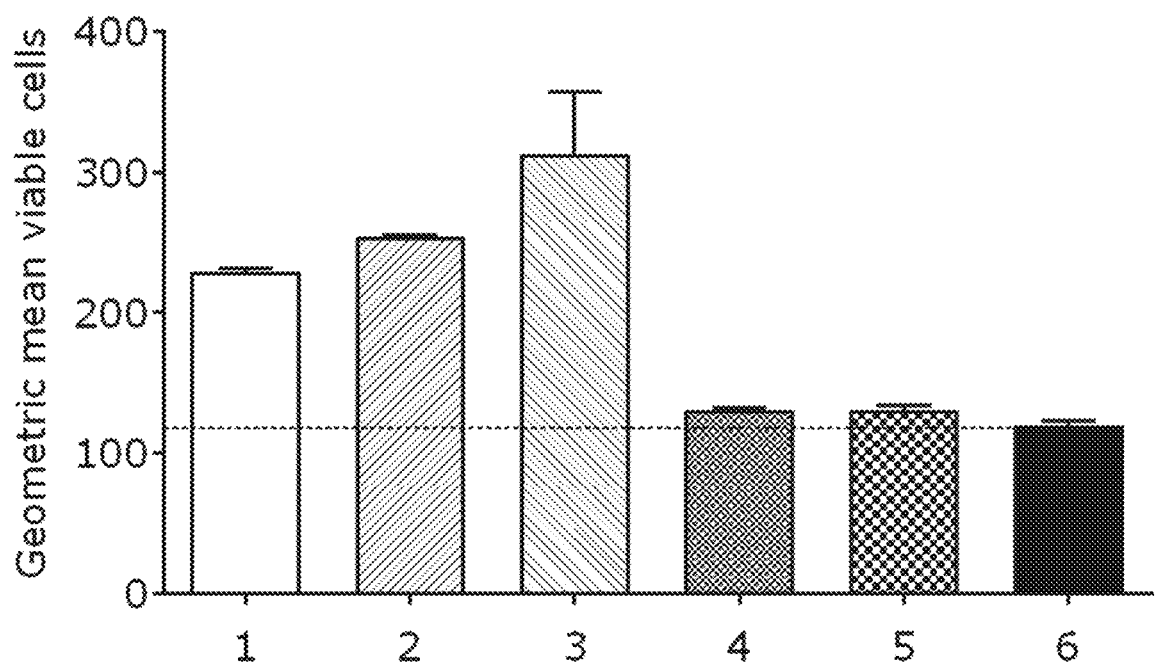
Figure 3:
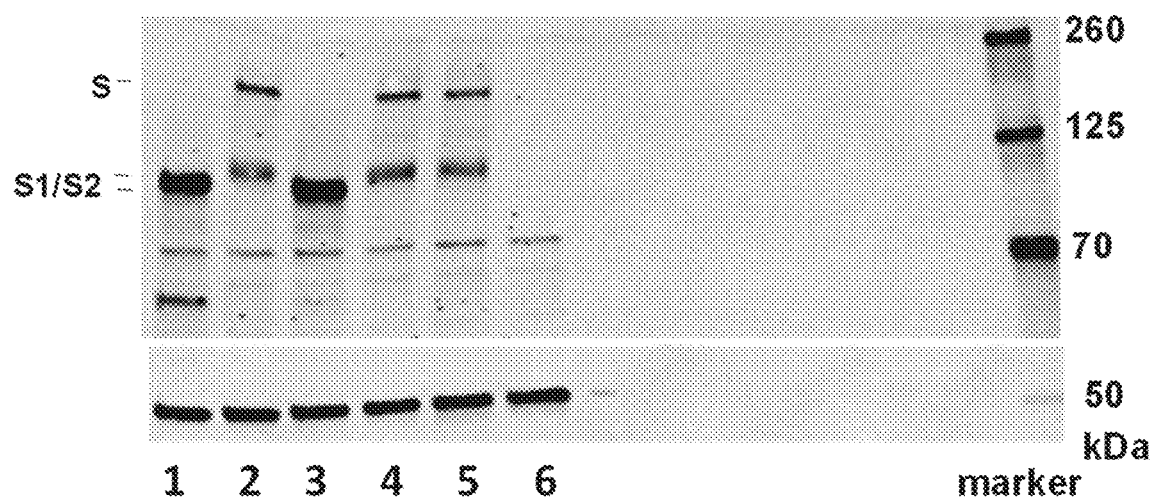

To determine in vitro protein expression of the mRNA constructs, the constructs encoding SARS-CoV-2 Spike proteins or fragments (S, S_stab, S1) were mixed with components of Promega Rabbit Reticulocyte Lysate System according to manufacturer's protocol. The lysate contains the cellular components necessary for protein synthesis (tRNA, ribosomes, amino acids, initiation, elongation and termination factors). As positive control, Luciferase RNA from Lysate System Kit was used. The translation result was analyzed by SDS-Page and Western Blot analysis (IRDye 800CW streptavidin antibody (1:2000)). Table 5 summarizes the tested RNA constructs.

TABLE 5

Overview of mRNA constructs used in Example 2a

| Lane | Name | Short name | CDS opt. | mRNA ID | SEQ ID NO: RNA |
|---|---|---|---|---|---|
| 1 | Spike protein | S | opt1 | R9514 | 162, 12743 |
| 2 | Spike pre-fusion stabilized protein | S_stab | opt10 | R9519 | 165, 13013 |
| 3 | Spike pre-fusion stabilized protein | S_stab | opt1 | R9515 | 163, 12810 |
| 4 | S fragment (1-681) spike protein | S1 | opt10 | R9518 | 168, 13027 |
| 5 | S fragment (1-681) spike protein | S1 | opt1 | R9513 | 166, 12824 |
| 6 | RNAse free water | | | | |
| 7 | Positive control, control RNA from Lysate System Kit | | | | |

Results:

As shown in FIG. 1 the used mRNA constructs led to a detectable protein expression of the expected size (S or S_stab: 140 kDa, S1: 75 kDa), which is a prerequisite for an mRNA-based SARS-CoV-2 vaccine.

Example 2b: Expression of SARS-CoV-2 Proteins (S, S_Stab, S1) in HeLa Cells and Analysis by FACS To determine in vitro protein expression of the mRNA constructs, HeLa cells were transiently transfected with mRNA encoding SARS-CoV-2 proteins (S, S_stab, S1) and stained using suitable anti-spike protein antibodies (raised in mouse), counterstained with a FITC-coupled secondary antibody. HeLa cells were seeded in a 6-well plate at a density of 400,000 cells/well in cell culture medium (RPMI, 10% FCS, 1% L-Glutamine, 1% Pen/Strep), 24h prior to transfection. HeLa cells were transfected with 2 μg unformulated mRNA using Lipofectamine 2000 (Invitrogen). The mRNA constructs prepared according to Example 1 and listed in Table 6 were used in the experiment, including a negative control (water for injection). 24 hours post transfection, HeLa cells were stained with suitable anti-spike protein (S specific antibodies raised against SARS S, cross-reactive against SARS-Cov-2 S) antibodies (raised in mouse; 1:250) and anti-mouse FITC labelled secondary antibody (1:500) and subsequently were analyzed by flow cytometry (FACS) on a BD FACS Canto II using the FACS Diva software. Quantitative analysis of the fluorescent FITC signal was performed using the FlowJo software package (Tree Star, Inc.).

TABLE 6

Overview of mRNA constructs used in Example 2b

| Lane | Name | Short name | CDS opt. | mRNA ID | SEQ ID NO: RNA |
|---|---|---|---|---|---|
| 1 | Spike protein | S | opt1 | R9514 | 162, 12743 |
| 2 | Spike pre-fusion stabilized protein | S_stab | opt1 | R9515 | 163, 12810 |
| 3 | Spike pre-fusion stabilized protein | S_stab | opt10 | R9519 | 165, 13013 |
| 4 | S fragment (1-681) spike protein | S1 | opt1 | R9513 | 166, 12824 |
| 5 | S fragment (1-681) spike protein | S1 | opt10 | R9518 | 168, 13027 |
| 6 | RNAse free water | | | | |

Results:

As shown in FIG. 2 the used mRNA constructs led to a detectable cell surface expression for full length S (S and S_stab). Since the S1 fragments lack a transmembrane domain, their expression is not detectable on the cell surface (FIG. 2).

Example 2c: Expression Analysis of SARS-CoV-2 Proteins (S, S_Stab, S1) Using Western Blot For the analysis of SARS-CoV-2 S expression, HeLa cells were transfected with unformulated mRNA using Lipofectamine as the transfection agent. HeLa cells were seeded in a 6-well plate at a density of 300,000 cells/well. HeLa cells were transfected with 2 μg unformulated mRNA using Lipofectamine 2000 (Invitrogen). The mRNA constructs prepared according to Example 1 and listed in Table 7 were used in the experiment, including a negative control (water for injection). 24h post transfection, HeLa cells are detached by trypsin-free/EDTA buffer, harvested, and cell lysates are prepared. Cell lysates were subjected to SDS-PAGE followed by western blot detection. Western blot analysis was performed using an anti-spike protein (SARS S, cross-reactive against SARS-CoV-2 S) antibody used in combination with a suitable secondary antibody.

TABLE 7

Overview of mRNA constructs used in Example 2c

| Lane | Name | Short name | CDS opt. | mRNA ID | SEQ ID NO: RNA |
|---|---|---|---|---|---|
| 1 | S fragment (1-681) spike protein | S1 | opt1 | R9513 | 166, 12824 |
| 2 | Spike protein | S | opt1 | R9514 | 162, 12743 |
| 3 | S fragment (1-681) spike protein | S1 | opt10 | R9518 | 168, 13027 |
| 4 | Spike pre-fusion stabilized protein | S_stab | opt10 | R9519 | 165, 13013 |
| 5 | Spike pre-fusion stabilized protein | S_stab | opt1 | R9515 | 163, 12810 |
| 6 | RNAse free water | | | | |

Results:

Expression was detectable for all analyzed mRNAs in cell lysates (FIG. 3), full length S: expected size 140 kDa, two main bands of approx. 90 kDA and 180 kDa, likely reflecting glycosylated forms of unprocessed S protein (S0) and the cleaved S2 subunit, S1: 70 kDa, likely glycosylated).

Example 3: Vaccination of Mice with mRNA Encoding SARS-CoV-2 Protein Designs Antigens (S. S_Stab Preparation of LNP Formulated mRNA Vaccine:
SARS-CoV-2mRNA constructs are prepared as described in Example 1 (RNA in vitro transcription). HPLC purified mRNA is formulated with LNPs according to Example 1.4 prior to use in in vivo vaccination experiments.

Immunization:
Female BALB/c mice (6-8 weeks old) are injected intramuscularly (i.m.) with mRNA vaccine compositions and doses as indicated in Table 5. As a negative control, one group of mice is vaccinated with buffer. All animals are vaccinated on day 0 and 21. Blood samples are collected on day 21 (post prime) and 42 (post boost) for the determination of antibody titers.

TABLE 8

Vaccination regimen (Example 3):

| Group | SARS-CoV-2 spike protein SEQ ID NO: | CDS optimization | Formulation | Dose |
|---|---|---|---|---|
| 1 | S<br>SEQ ID NO: 148, 155, 162, or 169 | opt1 | LNP | 5 μg |
| 2 | S<br>SEQ ID NO: 148, 155, 162, or 169 | opt1 | LNP | 2.5 μg |
| 3 | S<br>SEQ ID NO: 148, 155, 162, or 169 | opt1 | LNP | 1.25 μg |
| 4 | S stabilized (S_stab)<br>SEQ ID NO: 149, 156, 163, or 170 | opt1 | LNP | 5 μg |

TABLE 8-continued

Vaccination regimen (Example 3):

| Group | SARS-CoV-2 spike protein SEQ ID NO: | CDS optimization | Formulation | Dose |
|---|---|---|---|---|
| 5 | S stabilized (S_stab) SEQ ID NO: 149, 156, 163, or 170 | opt1 | LNP | 2.5 μg |
| 6 | S stabilized (S_stab) SEQ ID NO: 149, 156, 163, or 170 | opt1 | LNP | 1.25 μg |
| 7 | S stabilized (S_stab) SEQ ID NO: 150, 157, 164, or 171 | opt3 | LNP | 5 μg |
| 8 | S stabilized (S_stab) SEQ ID NO: 150, 157, 164, or 171 | opt3 | LNP | 2.5 μg |
| 9 | S stabilized (S_stab) SEQ ID NO: 150, 157, 164, or 171 | opt3 | LNP | 1.25 μg |
| 7 | S stabilized (S_stab) SEQ ID NO: 151, 158, 165, or 172 | opt10 | LNP | 5 μg |
| 8 | S stabilized (S_stab) SEQ ID NO: 151, 158, 165, or 172 | opt10 | LNP | 2.5 μg |
| 9 | S stabilized (S_stab) SEQ ID NO: 151, 158, 165, or 172 | opt10 | LNP | 1.25 μg |
| 10 | buffer | | | |

Determination of IgG1 and IgG2 Antibody Titers Using ELISA:

ELISA is performed using recombinant SARS-CoV-2 S (extracellular domain) protein for coating. Coated plates are incubated using respective serum dilutions, and binding of specific antibodies to the SARS-CoV-2 S are detected using biotinylated isotype specific anti-mouse antibodies followed by streptavidin-HRP (horse radish peroxidase) with Amplex as substrate. Endpoint titers of antibodies (IgG1, IgG2a) are measured by ELISA on day 21, and 42 post vaccinations.

Detection of Spike Protein-Specific Immune Responses:

Hela cells are transfected with 2 μg of mRNA encoding spike protein using lipofectamine. The cells are harvested 20h post transfection, and seeded at $1 \times 10^5$ per well into a 96 well plate. The cells are incubated with serum samples of vaccinated mice (diluted 1:50) followed by a FITC-conjugated anti-mouse IgG antibody. Cells were acquired on BD FACS Canto II using DIVA software and analyzed by FlowJo.

Intracellular Cytokine Staining:

Splenocytes from vaccinated mice are isolated according to a standard protocol known in the art. Briefly, isolated spleens are grinded through a cell strainer and washed in PBS/1% FBS followed by red blood cell lysis. After an extensive washing step with PBS/1% FBS, splenocytes are seeded into 96-well plates ($2 \times 10^6$ cells per well). Cells are stimulated with a mixture of SARS-CoV-2 S protein specific peptide epitopes (5 μg/ml of each peptide) in the presence of 2.5 μg/ml of an anti-CD28 antibody (BD Biosciences) for 6 hours at 37° C. in the presence of a protein transport inhibitor. After stimulation, cells are washed and stained for intracellular cytokines using the Cytofix/Cytoperm reagent (BD Biosciences) according to the manufacturer's instructions. The following antibodies are used for staining: Thy1.2-FITC (1:200), CD8-APC-H7 (1:100), TNF-PE (1:100), IFNγ-APC (1:100) (eBioscience), CD4-BD Horizon V450 (1:200) (BD Biosciences) and incubated with Fcγ-block diluted 1:100. Aqua Dye is used to distinguish live/dead cells (Invitrogen). Cells are acquired using a Canto II flow cytometer (Beckton Dickinson). Flow cytometry data is analyzed using FlowJo software package (Tree Star, Inc.)

Determination of Virus Neutralization Titers:

Serum is collected for determination of SARS-CoV-2 neutralization titers (VNTs) detected via CPE (cytopathic effect) or via a pseudotyped particle-based assay.

Example 4: Vaccination of Mice with mRNA Encoding SARS-CoV-2 Antigen S1

Preparation of LNP Formulated mRNA Vaccine:

SARS-CoV-2 mRNA constructs are prepared as described in Example 1 (RNA in vitro transcription). HPLC purified mRNA is formulated with LNPs according to Example 1.4 prior to use in in vivo vaccination experiments.

Immunization:

Female BALB/c mice (6-8 weeks old) are injected intramuscularly (i.m.) with mRNA vaccine compositions and doses as indicated in Table 6. As a negative control, one group of mice is vaccinated with buffer. All animals are vaccinated on day 0 and 21. Blood samples are collected on day 21 (post prime) and 42 (post boost) for the determination of antibody titers.

TABLE 9

Vaccination regimen (Example 4)

| Group | SARS-CoV-2 spike protein SEQ ID NO: | CDS optimization | Formulation | Dose |
|---|---|---|---|---|
| 1 | Spike S1 SEQ ID NO: 152, 159, 166, or 173 | opt1 | LNP | 5 μg |
| 2 | Spike S1 SEQ ID NO: 152, 159, 166, or 173 | opt1 | LNP | 2.5 μg |
| 3 | Spike S1 SEQ ID NO: 152, 159, 166, or 173 | opt1 | LNP | 1.25 μg |

TABLE 9-continued

Vaccination regimen (Example 4)

| Group | SARS-CoV-2 spike protein SEQ ID NO: | CDS optimization | Formulation | Dose |
|---|---|---|---|---|
| 1 | Spike S1 SEQ ID NO: 153, 160, 167, or 161 | opt3 | LNP | 5 µg |
| 2 | Spike S1 SEQ ID NO: 153, 160, 167, or 161 | opt3 | LNP | 2.5 µg |
| 3 | Spike S1 SEQ ID NO: 153, 160, 167, or 161 | opt3 | LNP | 1.25 µg |
| 1 | Spike S1 SEQ ID NO: 154, 161, 168, or 175 | opt10 | LNP | 5 µg |
| 2 | Spike S1 SEQ ID NO: 154, 161, 168, or 175 | opt10 | LNP | 2.5 µg |
| 3 | Spike S1 SEQ ID NO: 154, 161, 168, or 175 | opt10 | LNP | 1.25 µg |
| 4 | buffer | | | |

The induction of specific immune responses via ELISA, ICS and VNTs are determined as described before (see Example 3).

Example 5: Vaccination of Mice with mRNA Encoding SARS-CoV-2 Antigen Design (S_Stab Preparation of LNP Formulated mRNA Vaccine:

SARS-CoV-2 S mRNA constructs are prepared as described in Example 1 (RNA in vitro transcription). HPLC purified mRNA was formulated with LNPs according to Example 1.4.

Immunization:

Female BALB/c mice (6-8 weeks old) were injected intramuscularly (i.m.) with mRNA vaccine compositions and doses as indicated in Table 10. As a negative control, one group of mice was vaccinated with buffer. All animals were vaccinated on day 0. Blood samples were collected on day 21 for the determination of antibody titers.

TABLE 10

Vaccination regimen (Example 5):

| Group | Vaccine composition | mRNA ID | CDS opt. | SEQ ID NO: Protein | SEQ ID NO: RNA | Dose |
|---|---|---|---|---|---|---|
| A | mRNA encoding S_stab formulated in LNPs | R9519 | opt10 | 10, 341 | 165, 13013 | 2 µg |
| B | Rec. protein SARS-CoV-2 S ECD (extracellular domain) + alum | — | — | | | 1.5 µg |
| C | buffer | — | — | | | — |

Determination of IgG1 and IgG2 Antibody Titers Using ELISA:

ELISA was performed using recombinant SARS-CoV-2 S protein for coating. Coated plates were incubated using respective serum dilutions, and binding of specific antibodies to SARS-CoV-2 S were detected using biotinylated isotype specific anti-mouse antibodies followed by streptavidin-HRP (horse radish peroxidase) with Amplex as substrate. Endpoint titers of antibodies (IgG1, IgG2a) were measured by ELISA on day 21, after one single prime vaccination.

Results:

As shown in FIG. 4 the vaccination with mRNA encoding for full length S stabilized protein induced high titers of S specific binding antibody after a single vaccination (d21). Compared to the adjuvanted recombinant S protein the mRNA vaccine induced comparable IgG1 titers and higher IgG2a titers.

Example 6: Vaccination of Mice with mRNA Encoding SARS-CoV-2 Antigen Designs Preparation of LNP Formulated mRNA Vaccine:

SARS-CoV-2 S mRNA constructs are prepared as described in Example 1 (RNA in vitro transcription). HPLC purified mRNA was formulated with LNPs according to Example 1.4.

Immunization:

Female BALB/c mice (6-8 weeks old) were injected intramuscularly (i.m.) with mRNA vaccine compositions and doses as indicated in Table 11. As a negative control, one group of mice was vaccinated with buffer. All animals were vaccinated on day 0 and 21. Blood samples were collected on day 21 (post prime) and 42 (post boost) for the determination of antibody titers.

TABLE 11

Vaccination regimen (Example 6):

| Group | Vaccine composition | mRNA ID | CDS opt. | SEQ ID NO: Protein | SEQ ID NO: RNA | Dose |
|---|---|---|---|---|---|---|
| A | mRNA encoding S_full length formulated in LNPs | R9514 | opt1 | 1 | 162 | 2 μg |
| B | mRNA encoding S_stab formulated in LNPs | R9515 | opt1 | 10 | 163 | 2 μg |
| C | mRNA encoding S_stab formulated in LNPs | R9519 | opt10 | 10 | 165 | 2 μg |
| D | buffer | — | — | | | — |

Determination of IgG1 and IgG2 Antibody Titers Using ELISA:

ELISA was performed using recombinant SARS-CoV-2 S (extracellular domain) protein for coating. Coated plates were incubated using respective serum dilutions, and binding of specific antibodies to SARS-CoV-2 S were detected using biotinylated isotype specific anti-mouse antibodies followed by streptavidin-HRP (horse radish peroxidase) with Amplex as substrate. Endpoint titers of antibodies (IgG1, IgG2a) were measured by ELISA on day 21, and 42 post prime vaccination.

Determination of Virus Neutralization Titers:

Serum was collected for determination of SARS-CoV-2 neutralization titers (VNTs) detected via CPE (cytopathic effect). Serial dilutions of heat-inactivated sera (56° C. for 30 min) tested in duplicates with a starting dilution of 1:10 followed by 1:2 serial dilutions were incubated with 100 $TCID_{50}$ of wild type SARS-CoV-2 (strain 2019-nCov/Italy-INMI1) for 1 hour at 37° C. Every plate contained a dedicated row (8 wells) for cell control which contains only cells and medium, and a dedicated row of virus control which contain only cells and virus. Infectious virus was quantified upon incubation of 100 μl of virus-serum mixture with a confluent layer of Vero E6 cells (ATCC, Cat. 1586) followed by incubation for 3 days at 370C and microscopical scoring for CPE formation. A back titration was performed for each run in order to verify the correct range of TCID50 of the working virus solution. VN titres were calculated according to the method described by Reed & Muench. If no neutralization was observed (MNt<10), an arbitrary value of 5 was reported. Analyses were carried out at VisMederi srl (Siena, Italy).

Intracellular Cytokine Staining:

Splenocytes from vaccinated mice were isolated according to a standard protocol known in the art. Briefly, isolated spleens were grinded through a cell strainer and washed in PBS/1% FBS followed by red blood cell lysis. After an extensive washing step with PBS/1% FBS, splenocytes were seeded into 96-well plates ($2\times10^6$ cells per well). Cells were stimulated with a mixture of SARS-CoV-2 S protein specific peptide epitopes (5 μg/ml of each peptide) in the presence of 2.5 μg/ml of an anti-CD28 antibody (BD Biosciences) for 6 hours at 37° C. in the presence of a protein transport inhibitor. After stimulation, cells were washed and stained for intracellular cytokines using the Cytofix/Cytoperm reagent (BD Biosciences) according to the manufacturer's instructions. The following antibodies were used for staining: Thy1.2-FITC (1:200), CD8-APC-H7 (1:100), TNF-PE (1:100), IFNγ-APC (1:100) (eBioscience), CD4-BD Horizon V450 (1:200) (BD Biosciences) and incubated with Fcγ-block diluted 1:100. Aqua Dye was used to distinguish live/dead cells (Invitrogen). Cells were acquired using a Canto II flow cytometer (Beckton Dickinson). Flow cytometry data was analyzed using FlowJo software package (Tree Star, Inc.)

Results:

As shown in FIGS. 5A and B the vaccination with mRNA encoding full length S protein and full length S stabilized protein (S_stab) induced high titers of S specific binding antibody after a single vaccination (d21) (FIG. 5A: IgG1, FIG. 5B: IgG2a). The titers increased after a second vaccination (d42). All mRNA designs induced more or less comparable antibody titers, whereas mice of group C showed a decreased level of IgG2a antibodies on d21 compared to other groups. As shown in FIG. 5C the vaccination with mRNA encoding for full length S protein and full length S stabilized protein induced robust levels of virus neutralizing antibodies after two vaccinations.

As shown in FIG. 6 the vaccination with mRNA encoding for full length S protein and full length S stabilized (S_stab) protein induced both CD4+ and $CD8^+$ IFNγ/TNF double positive T cells.

Example 7: In Vivo Immunogenicity of SARS-CoV-2 Vaccine Composition Following Different Vaccination Schedules Preparation of LNP Formulated mRNA Vaccine:

SARS-CoV-2 S mRNA constructs are prepared as described in Example 1 (RNA in vitro transcription). HPLC purified mRNA were formulated with LNPs according to Example 1.4.

Immunization:

Female BALB/c mice (6-8 weeks old) were injected intramuscularly (i.m.) with mRNA vaccine compositions and doses as indicated in Table 12. Group I was vaccinated with Alum adjuvanted SARS-CoV2 spike protein (S extracellular domain) (1.5 μg in 5.6 μl Alhydrogel buffered in phosphate buffered saline [PBS]). As a negative control, one group of mice was vaccinated with buffer (0.9% NaCl).

Animals received their first vaccination on day 0, day 7, day 14 or day 21. All animals received a second vaccination on day 28. The presence of SARS-CoV 2 S binding antibodies was analyzed on day 28 and day 35, the presence of virus-neutralizing titers (VNTs) was analyzed on day 28, 35 and 49. The induction of T cell responses after vaccination was assessed on day 49 of the experiment. This experimental setup was chosen to determine the onset of the specific immune responses and to ascertain which vaccination interval from first to second immunization yields the highest immune responses in mice.

using biotinylated isotype specific anti-mouse antibodies followed by streptavidin-HRP (horse radish peroxidase) with Amplex as substrate.

Determination of Virus Neutralization Titers:

Serum was collected for determination of SARS-CoV-2 neutralization titers (VNTs) detected via CPE (cytopathic effect) using wild type SARS-CoV-2 virus. For the analysis of virus neutralizing titres of mouse sera, serial dilutions of heat-inactivated sera (56° C. for 30 min) tested in duplicates with a starting dilution of 1:10 followed by 1:2 serial dilutions were incubated with 100 $TCID_{50}$ of wild type SARS-CoV-2 (strain 2019-nCov/Italy-INMI1) for 1 hour at 37° C. Every plate contained a dedicated row (8 wells) for

TABLE 12

| | Vaccination regimen (Example 7): | | | | | | |
|---|---|---|---|---|---|---|---|
| Group | Vaccine composition | mRNA ID | vaccination | CDS opt. | SEQ ID NO: Protein | SEQ ID NO: RNA | Dose |
| A | mRNA encoding S_stab formulated in LNPs (CVnCoV) | R9515 | d21, d28 | opt1 | 10 | 163 | 2 µg |
| B | mRNA encoding S_stab formulated in LNPs (CVnCoV) | R9515 | d14, d28 | opt1 | 10 | 163 | 2 µg |
| C | mRNA encoding S_stab formulated in LNPs (CVnCoV) | R9515 | d7, d28 | opt1 | 10 | 163 | 2 µg |
| D | mRNA encoding S_stab formulated in LNPs (CVnCoV) | R9515 | d0, d28 | opt1 | 10 | 163 | 2 µg |
| E | mRNA encoding S_stab formulated in LNPs | R9519 | d21, d28 | opt10 | 10 | 165 | 2 µg |
| F | mRNA encoding S_stab formulated in LNPs | R9519 | d14, d28 | opt10 | 10 | 165 | 2 µg |
| G | mRNA encoding S_stab formulated in LNPs | R9519 | d7, d28 | opt10 | 10 | 165 | 2 µg |
| H | mRNA encoding S_stab formulated in LNPs | R9519 | d0, d28 | opt10 | 10 | 165 | 2 µg |
| I | Pos. control (alum adjuvanted S protein) | — | d0, d28 | — | — | — | — |
| J | Buffer | — | d0, d28 | — | — | — | — |

Characterisation of RNA-Induced Innate Immune Responses:

Blood samples were taken via retro-orbital bleeding 14h after administration of mRNA encoding S_stab formulated in LNPs (exemplarily shown for group A), positive control, or buffer. Serum cytokines (IFN-γ, IL-1β TNF, IL-6, IL-4, IL-5 and IL-13) were assessed using cytometric bead array (CBA) using the BD FACS CANTO II. Serum was diluted 1:4 and BD Bioscience mouse cytokine flex sets were used according to manufacturer's protocol to determine serum cytokine levels.

The following flex set were used: Mouse IFN-γ Flex Set RUO (A4) (BD Bioscience, Cat. 558296); Mouse Il-13 Flex Set RUO (B8) (BD Bioscience, Cat. 558349); Mouse IL-1β Flex Set RUO (E5) (BD Bioscience, Cat. 560232); Mouse Il-4 Flex Set RUO (A7) (BD Bioscience, Cat. 558298); Mouse Il-5 Flex Set RUO (A6) (BD Bioscience, Cat. 558302); Mouse IL-6 Flex Set RUO (B4) (BD Bioscience, Cat. 558301); Mouse TNF Flex Set RUO (C8) (BD Bioscience, Cat. 558299). IFN-α was quantified using VeriKine-HS Mouse IFN-α Serum ELISA Kit (pbl, Cat. 42115-1) according to manufacturer's instructions. Sera were diluted 1:100 and 50 µl of the dilution was tested.

Determination of IgG1 and IgG2 Antibody Titers Using ELISA:

ELISA was performed using recombinant SARS-CoV-2 S (extracellular domain) protein for coating. Coated plates were incubated using respective serum dilutions, and binding of specific antibodies to SARS-CoV-2 S were detected using biotinylated isotype specific anti-mouse antibodies followed by streptavidin-HRP (horse radish peroxidase) with Amplex as substrate.

cell control which contains only cells and medium, and a dedicated row of virus control which contain only cells and virus. Infectious virus was quantified upon incubation of 100 µl of virus-serum mixture with a confluent layer of Vero E6 cells (ATCC, Cat. 1586) followed by incubation for 3 days at 37° C. and microscopical scoring for CPE formation. A back titration was performed for each run in order to verify the correct range of $TCID_{50}$ of the working virus solution. VN titres were calculated according to the method described by Reed & Muench. If no neutralization was observed (MNt<10), an arbitrary value of 5 was reported. Analyses were carried out at VisMederi srl (Siena, Italy).

Intracellular Cytokine Staining:

Splenocytes were isolated and stimulated with SARS-CoV-2 spike specific peptide library for 24 hours. Subsequently cells were stained for cluster of differentiation 8 (CD8) and CD4 T cells (surface) and for INF-γ and TNF (intracellular) to evaluate the induction of multifunctional T cells specifically activated by vaccine-specific peptides. Cells incubated with dimethyl sulfoxide (DMSO) served as negative controls. Cells were acquired using a Canto II flow cytometer (Beckton Dickinson). Flow cytometry data was analyzed using FlowJo software package (Tree Star, Inc.)

Results

Figure 7:
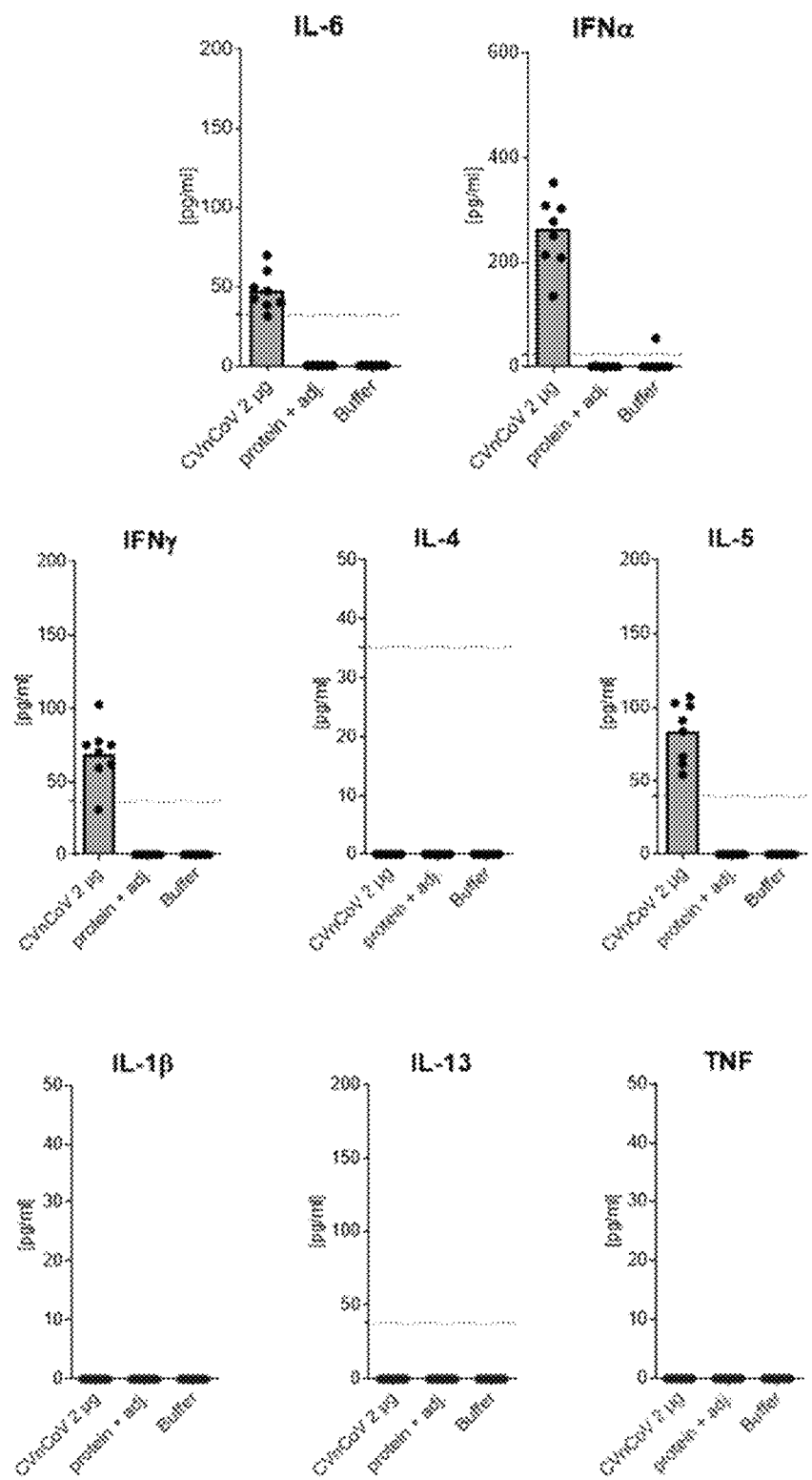

As shown in FIG. 7 the cytokine analyses demonstrated the induction of a balanced immune response upon mRNA encoding S_stab formulated in LNPs (CVnCoV) injection that exhibited no bias towards IFNγ or IL4, IL-5 and IL-13, indicative of a TH1 and TH2 response, respectively. Low levels of pro-inflammatory cytokines IL-6, IFNα were detectable in serum, while TNF and IL1β remained undetectable.

Figure 8A:
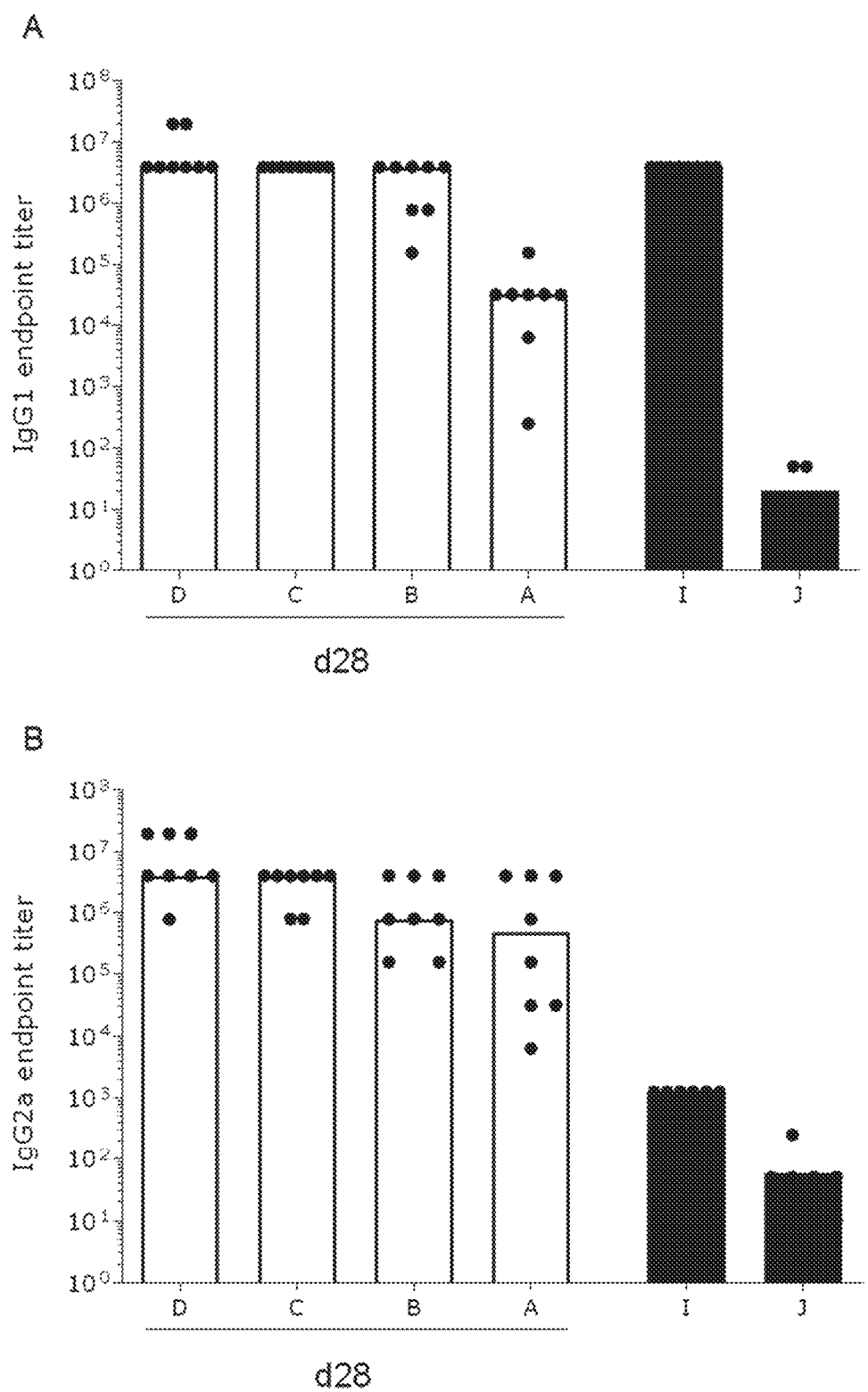

As shown in FIG. 8A the vaccination with mRNA R9515 encoding full length S stabilized protein (S_stab) induced a fast onset of immune response upon first vaccination. A single i.m. administration of the vaccine composition was sufficient to induce binding antibodies seven days post-injection.

Figure 8B:
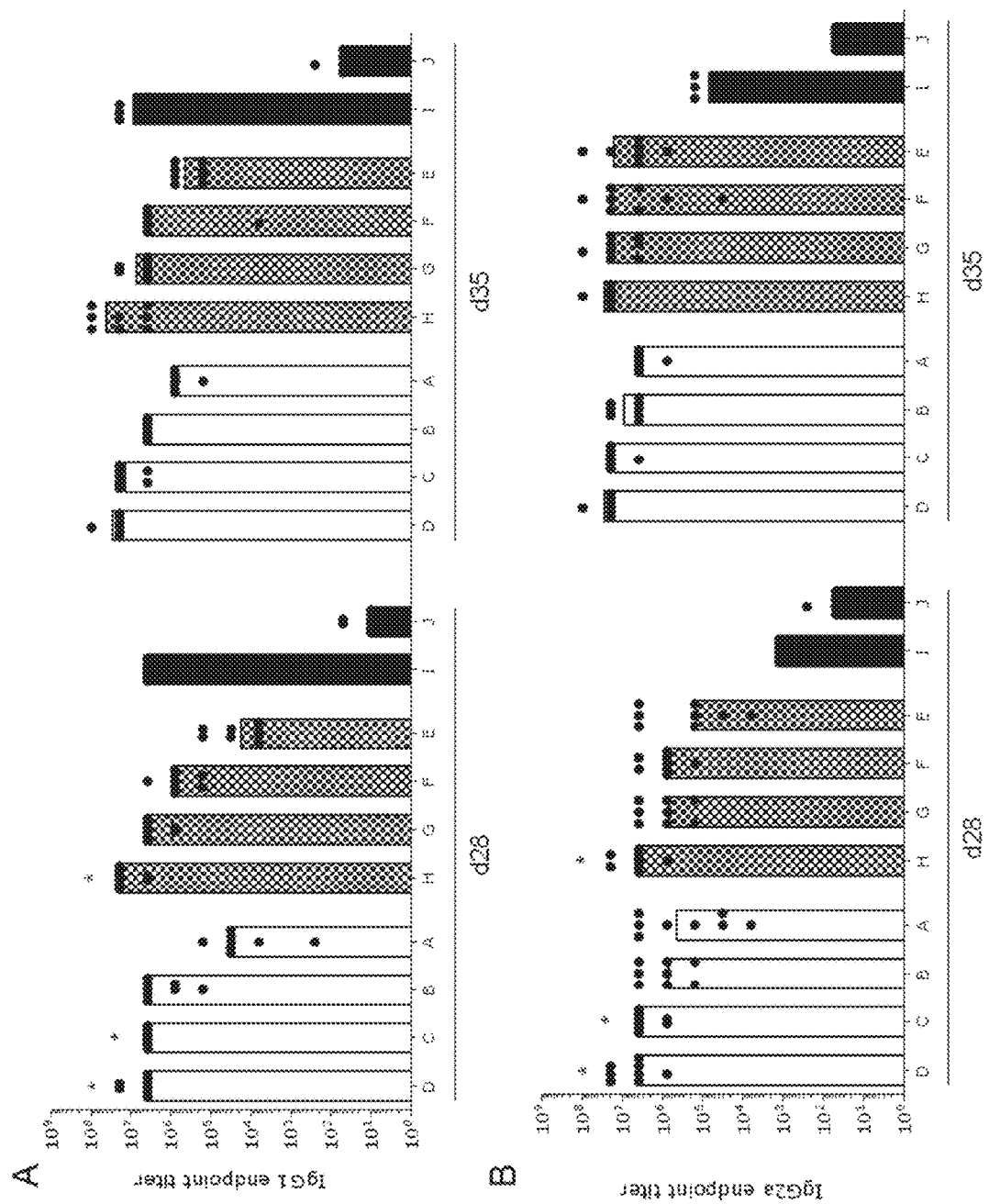

As shown in FIG. 8B the vaccination with mRNA encoding full length S stabilized protein (S_stab) induced comparable antibody titers independently of CDS optimization. Levels of binding antibodies increased with longer intervals between vaccination and serum sampling (FIG. 8A+B). A second immunization was able to increase the overall titers of binding antibodies one week post-injection (day 35). Higher levels of binding antibody titers were observed on day 35 in groups featuring longer intervals between first and second immunization. Adjuvanted recombinant spike protein vaccine (group I) induced comparable levels of binding IgG1 antibodies, but IgG2a titers were statistically significantly lower compared to all mRNA groups.

As shown in FIG. 9A+B, low, but detectable levels of VNTs were present 28 days post first vaccination (group D and H). VNT levels increased after the second immunization across all groups analyzed on day 35 and day 49 of the study. In line with the increased binding antibodies, VNTs increased over time and for groups with longer intervals between first and second vaccination.

As shown in FIG. 10, a strong increase in multifunctional CD8+ and CD4+ T cells was observed in vaccinated animals.

Strong induction of multifunctional T cells as well as binding and, more importantly, of functional antibodies suggest that the mRNA vaccine encoding the SARS-CoV-2 spike protein elicits potent immune responses in mice.

The vaccine elicited a balanced Th1/Th2 profile, indicated by the induction of comparable levels of IgG1 and IgG2a antibodies as well as a cytokine profile that gives no indication of a TH2 bias, i.e. induction of IL4, IL5 and IL13.

Example 8: Vaccination of Rats with mRNA Encoding SARS-CoV-2 Antigen

Preparation of LNP Formulated mRNA Vaccine:

SARS-CoV-2 S mRNA constructs are prepared as described in Example 1 (RNA in vitro transcription). HPLC purified mRNA was formulated with LNPs according to Example 1.4 prior to use in in vivo vaccination experiments.

Immunization and Challenge:

Syrian golden hamsters (n=5/group, 11 to 13 weeks old) were injected intramuscularly (i.m.) with mRNA vaccine compositions and doses as indicated in Table 14 (see e.g. group E and F). As negative controls, one group of hamsters was not treated and mock infected (with buffer) (group A), another group was injected with NaCl as a buffer control. As a positive control, group C was infected intranasally with $10^2$ TCID50/dose of SARS CoV-2 isolate BetaCoV/Munich/BavPat1/2020 (containing a D614G substitution) in 0.1 ml on day 0. As an additional positive control, group D was injected intramuscularly with 5 µg of recombinant SARS-CoV-2 spike protein (S1+S2 ECD, His tag; Sino Biological, Cat. 40589-V08B1) adjuvanted in Alhydrogel (Brenntag) 2%. Blood samples were collected on day 28 (post prime) and day 42 and 56 (post boost) for the determination of antibody titers. The animals were challenged intranasally with $10^2$ TCID50/dose of SARS CoV-2 in a total dose volume of 0.1 ml at day 56. Animals were followed for four days post challenge (p.c.) and euthanised on day 60 of the experiment.

ferred to 96 well plates with Vero E6 cell culture monolayers and incubated for one hour at 37° C. Cell monolayers were washed prior to incubation for five days at 370C. Plates were then scored using the vitality marker WST8 and viral titers (Log10 TCID50/ml or/g) were calculated using the method of Spearman-Karber.

Histopathology Upon Challenge in Hamsters

Histopathological analysis was performed on tissues sampled on day 4 post challenge. After fixation with 10% formalin, sections were embedded in paraffin and the tissue sections were stained with haematoxylin and eosin for histological examination. Histopathological assessment scoring is as follows: Alveolitis severity, bronchitis/bronchiolitis severity: 0=no inflammatory cells, 1=few inflammatory cells, 2=moderate number of inflammatory cells, 3=many inflammatory cells. Alveolitis extent, 0=0%, 1=<25%, 2=25-50%, 3=>50%. Alveolar oedema presence, alveolar haemorrhage presence, type II pneumocyte hyperplasia presence, 0=no, 1=yes. Extent of peribronchial/perivascular cuffing, 0=none, 1=1-2 cells thick, 2=3-10 cells thick, 3=>10 cells thick.

TABLE 14

Vaccination regimen (Example 9):

| Group | Vaccine composition | mRNA ID | dose | vaccination | CDS opt. | SEQ ID NO: Protein | SEQ ID NO: RNA |
|---|---|---|---|---|---|---|---|
| A | Untreated/mock infected | | | | — | — | — |
| B | NaCl | | | d0, d28 | — | — | — |
| C | SARS-CoV-2 infected | | $10^2$ TCID$_{50}$ | d0 | — | — | — |
| D | Pos. control (alum adjuvanted S protein) | | 1.5 µg | d0, d28 | — | — | — |
| E | mRNA encoding S_stab formulated in LNPs (CVnCoV) | R9515 | 2 µg | d0, d28 | opt1 | 10 | 163 |
| F | mRNA encoding S_stab formulated in LNPs (CVnCoV) | R9515 | 10 µg | d0, d28 | opt1 | 10 | 163 |

Antibody Analysis

Blood samples were taken at day 28, 42, and 56 for the determination of total IgG antibodies via ELISA. Plates were coated with 1 µg/ml of SARS-CoV-2 spike S (extracellular domain) protein for 4-5h at 370C. Plates were blocked overnight in 10% milk, washed and incubated with serum for 2h at room temperature. For detection, hamster sera were incubated with biotin goat anti-hamster (Syrian) IgG antibody (BioLegend, Cat: 405601) followed by incubation with HRP-Streptavidin (BD, Cat: 554066). Detection of specific signals was performed in a BioTek SynergyHTX plate reader, with excitation 530/25, emission detection 590/35 and a sensitivity of 45. IgG antibody titers via ELISA for infected animals (group C) were not analyzed.

Virus neutralizing antibody titers (VNT) of hamster serum samples were analysed upon heat inactivation of samples for 30 min at 56° C. Triplicate, serial two-fold dilutions were incubated with $10^2$ TCID50/well SARS-CoV-2 virus (featuring the mutation D614G) for one hour at 370C leading to a sample starting dilution of 1:10. The virus-serum mixtures were transferred to 96 well plates with Vero E6 cell culture monolayers and incubated for five days at 37° C. Plates were then scored using the vitality marker WST8 and (100% endpoint) VN titers were calculated according to the method described by Reed & Muench.

Viral Load in the Respiratory Tract

Detectable levels of replication competent virus in throat swabs, lung and nasal turbinate tissues post challenge were analysed. Quadruplicate, 10-fold serial dilutions were trans- Results As shown in FIG. 12A hamsters vaccinated with two CVnCoV doses of 2 µg or 10 µg in a 4-week interval developed dose-dependent S binding IgG antibodies after the first vaccination that increased upon the second. Median endpoint titres of animals vaccinated with 10 µg of CVnCoV were $1.6 \times 10^5$ after one dose and peaked at $7.8 \times 10^5$ on day 42. IgG antibody titers via ELISA for infected animals (group C) were not analyzed.

As shown in FIG. 12B, detectable levels of VNTs were present 28 days post first vaccination. VNT levels increased after the second immunization across both dose groups (group E and F) analyzed on day 42 and day 56 of the study. Virus employed for this assay featured the D614D mutation, while CVnCoV encoded S_stab does not include this mutation. Of note, a control group that received Alum-adjuvanted SECD protein developed IgG antibodies without inducing detectable levels of VNTs.

On day 56, four weeks after second vaccination, all animals were challenged with SARS-CoV-2 featuring D614G ($10^2$ TCID$_{50}$/dose). In buffer control animals, levels of replication-competent virus from throat swabs, taken daily from day 56 to termination on day 60, showed peak viral titres of approximately 103 TCID50/ml two days post challenge that returned to nearly undetectable levels on day 60. Animals previously infected with SARS-CoV-2 remained negative throughout the experiment. Viral levels were significantly reduced in throat swabs of both CVnCoV vaccinated groups. Vaccination with 10 µg of CVnCoV resulted in significantly diminished and delayed viral peaks at $10^{1.5}$ TCID50/ml three days post challenge. At least 2 out of 5 animals in this group remained negative throughout the testing period (see FIG. 12C).

Viral levels in nasal turbinates revealed less pronounced, but detectable dose-dependent reduction of viral replication (FIG. 12D). Importantly, animals vaccinated with 10 μg of CVnCoV exhibited no detectable viral levels in the lungs, proving the ability of CVnCoV to protect animals from viral replication in the lower respiratory tract (FIG. 12E).

Histopathological analyses demonstrated the occurrence of alveolar damage and inflammation of alveoli, bronchi and trachea in the buffer control group upon SARS-CoV-2 infection. Consistent with protection from viral replication in the lungs, CVnCoV significantly reduced histopathological changes upon two vaccinations with 10 μg. Importantly, a dose of 2 μg, which lead to the induction of binding antibodies but only elicited low levels of VNTs, did not induce increased histopathology scores. Group comparisons for differential gene expression in lung homogenates showed no significant change in the induction of IL-4 or IL-5 in the mRNA groups compared to buffer or mock infection groups (data not shown). Therefore, the inventors conclude that CVnCoV does not induce enhanced disease in hamsters, (e.g. via antibody dependent enhancement) even under conditions where breakthrough viral replication occurs. The presented data indicates that vaccination with Alum-adjuvanted protein vaccine, that elicits no detectable levels of VNTs but high levels of binding antibodies, causes increased histopathology scores in hamsters (FIG. 12F, Table 14).

TABLE 15

List of histopathological analysis indicated in FIG. 12F:

| | Histopathological analysis |
|---|---|
| 1 | Extend of alveolitis/alveolar damage |
| 2 | Severity of alveolitis |
| 3 | Sum of extend + severity alveolitis |
| 4 | Alveolar oedema presence |
| 5 | Alevolar haemorrhage presence |
| 6 | Type II pneumocytehyperplasia presence |
| 7 | Severity of bronchitis |
| 8 | Severity of bronchiolitis |
| 9 | Degree of peribronchial/perivascular cuffing |
| 10 | Severity of tracheitis |
| 11 | Severity of rhinitis |

Consistent with robust immune responses, CVnCoV protected hamsters from SARS-CoV-2 viral challenge featuring the D614G mutation in S, proving CVnCoV's ability to protect against the most prevalent form of the virus. These experiments showed significant reduction in replicating virus levels in the upper respiratory tract and the absence of detectable live virus in the lungs of animals upon two vaccinations with 10 μg of CVnCoV.

Example 10: Clinical Development of a SARS-CoV-2 mRNA Vaccine Composition

To demonstrate safety and immunogenicity of the mRNA vaccine composition(s), clinical trials (phase 1, 2a) were initiated. In the phase 1 clinical trial, cohorts of human volunteers (18-60 years) were intramuscularly injected for at least two times (e.g. day 1 and day 29 with a dose of 2 μg, 4 μg, 8 μg, 12 μg, 16 μg, or 20 μg mRNA encoding SARS-CoV-2 spike protein (R9515, SEQ ID No. 163) formulated in LNPs (as described in Example 1.4) according to the invention (CVnCoV)). In order to assess the safety profile of the vaccine compositions according to the invention, subjects are monitored after administration (vital signs, vaccination site and systemic reactogenicity assessments, hematologic analysis). The immunogenicity of the immunization is analyzed by determination of antibodies against SARS-CoV-2, virus neutralizing titers (VNT) and SARS-CoV-2 specific T cells in sera from vaccinated subjects. Blood samples are collected on day 1 as baseline, after each vaccination and during long-term follow-up.

Cohorts:

| | | 2 μg | 4 μg | 6 μg | 8 μg | 12 μg | 16 μg | 20 μg | Total |
|---|---|---|---|---|---|---|---|---|---|
| N | Seronegatives | 46 | 46 | 46 | 46 | 24 | 12 | 12 | 232 |
| N | Seropositives | 10 | 10 | 10 | 6 | 4 | 1 | | 41 |
| Total N | CVnCoV + placebo | 56 | 56 | 56 | 52 | 28 | 13 | 12 | 273 |

On Day 8, Day 15, Day 29, Day 36, Day 43, Day 57, Day 120, Day 211 and Day 393 the following was determined:
a.) The proportion of subjects seroconverting for SARS-CoV-2 spike protein antibodies, as measured by ELISA.
In subjects who did not get exposed to SARS-CoV-2 before the trial, or during the trial before the applicable sample was collected, as measured by ELISA to SARS-CoV-2 N-antigen, seroconversion is defined as an increase in titer in antibodies against SARS-CoV-2 spike protein versus baseline.
In subjects seropositive for SARS-CoV-2 at baseline, seroconversion is defined as a 2-fold increase in titer in antibodies against SARS-CoV-2 spike protein versus baseline.
b.) Individual SARS-CoV-2 spike protein-specific antibody levels in serum, as measured by ELISA.
c.) Geometric mean titers (GMTs) of serum SARS-CoV-2 spike protein antibodies, as measured by ELISA, in subjects who did not get exposed to SARS-CoV-2 before the trial or during the trial before the applicable sample was collected, as measured by ELISA to SARS-CoV-2 N-antigen.
d.) The proportion of subjects seroconverting for SARS-CoV-2 neutralizing antibodies, as measured by an activity assay.
In subjects who did not get exposed to SARS-CoV-2 before the trial or during the trial before the applicable sample was collected, as measured by ELISA to SARS-CoV-2 N-antigen, seroconversion is defined as an increase in titer in SARS-CoV-2 neutralizing antibodies versus baseline.
In subjects seropositive for SARS-CoV-2 at baseline, seroconversion is defined as a 2-fold increase in titer in SARS-CoV-2 neutralizing antibodies versus baseline.
e.) Individual SARS-CoV-2 neutralizing antibody levels in serum.

f.) GMTs of serum SARS-CoV-2 neutralizing antibodies, as measured by an activity assay, in subjects who did not get exposed to SARS-CoV-2 before the trial or during the trial before the applicable sample was collected, as measured by ELISA to SARS-CoV-2 N-antigen.

Cell-Mediated Immune Response

On Day 29, Day 36 and Day 211 in peripheral blood mononuclear cells (PBMCs) from all subjects at the assigned site(s) the following was determined:
a.) The frequency and functionality of SARS-CoV-2 spike-specific T-cell response after antigen stimulation.
b.) Intracellular cytokine staining (ICS) to investigate Th1 response and production of Th2 markers
c.) The proportion of subjects with a detectable increase in SARS-CoV-2 spike-specific T-cell response.

Innate Immune Response

On Day 2, Day 8, Day 29, Day 30 and Day 36 in all open-label sentinel subjects the following was determined:
a.) Serum cytokine concentrations, including but not limited to interferon (IFN)-α, IFN-γ, interleukin (IL)-6, chemokine ligand (CCL) 2 and IFN-γ-induced protein 10 (IP 10).
b.) Gene expression profiling.

Evaluation of Infection
a.) Number of subjects with virologically-confirmed SARS-CoV-2 infection as measured by reverse transcription (RT)-PCR at clinically was determined time points throughout the trial.
b.) Number of subjects with asymptomatic SARS-CoV-2 infection as measured by retrospective serology at predefined time points was determined.

Virus Neutralization:

Neutralizing activity of induced antibodies was determined by a cytopathic effect (CPE)-based micro-neutralization assay looking at 50% CPE by a viral infective dose 25 (MN 25 TCID50/well), using a wild-type viral strain (SARS-CoV-2 2019 nCOV ITALY/INMI1) on a VERO E6 cell line. The assays were performed in a 96-well plate format, human serum was diluted in a 1:2 serial dilution. The Micro-neutralization titre is the reciprocal of the highest sample dilution that protects from CPE at least 50% of cells and reported as the geometric mean of duplicates.

Elisa:

Antibody titres were measured with Elisa Assays using as target antigen either the extra cellular domain (ECD) of Spike or to the receptor binding domain (RBD). The antigen recombinant proteins used for coating were expressed in eukaryotic cells. Human serum were diluted 1:2 in a serial dilution, the titre is the reciprocal of the highest sample dilution over a cut-point defined as blank plus matrix effect. Titres are reported as geometric mean of duplicates.

T Cell Responses:

As an exploratory endpoint of this clinical trial, cell-mediated immune responses were evaluated by assessment of frequency and functionality of SARS-CoV-2 Spike-specific CD4+Th1 and cytotoxic CD8+ T cell responses after antigen stimulation. Moreover the proportion of subjects with a detectable increase in SARS-CoV-2 spike-specific T-cell responses after vaccination were determined.

Functional T cell responses were determined and quantified ex vivo by flow cytometry-based intracellular cytokine staining (ICS) of T cell activation markers and effector cytokines (CD40L, IFN-gamma, IL-2 and TNF-alpha) after stimulation of SARS-CoV-2 Spike-specific CD4+Th1 and cytotoxic CD8+ T cells with overlapping Spike peptide pools.

Results:

In FIG. 13A systemic adverse events are shown in the different dose cohorts after the first dose and after the second dose.

In FIG. 13B local adverse events are shown in the different dose cohorts after the first dose and after the second dose.

In FIG. 13C the specific systemic adverse events are shown, such as fatigue, headache, myalgia, chills, arthralgia, fever, nausea and diarrhea.

In FIG. 13D the specific local adverse events are shown, such as pain, itching, swelling and redness.

In summary the CvnCoV vaccine showed good safety properties and acceptable reactogenicity.

In FIG. 13E induction of Spike protein specific IgG antibodies on day 1, 29, 36, 43 and 57 is shown for the different dose cohorts. All vaccinated subjects showed good induction of Spike-specific antibodies, wherein the 12 µg cohort showed the same level of antibodies as seroconverted patients (HCS). In the table of FIG. 13E percentage of seroconversion of the vaccinated subjects is shown. In most of the cases more than 90% of the vaccinated subjects showed a more than 2fold increase in Spike protein-specific antibodies compared to baseline on day 43. In all dose groups at least 70% of the vaccinated subjects showed a more than 4fold increase in Spike protein-specific antibodies compared to baseline. In the 12 µg even more than 90% of the subjects showed a more than 4fold increase in antibodies.

In FIG. 13F induction of RBD-specific IgG antibodies on day 1, 36, and 43 is shown for the different dose cohorts. All vaccinated subjects showed good induction of RBD-specific antibodies, wherein the 12 µg cohort showed the same level of antibodies as seroconverted patients (HCS). In the table of FIG. 13F percentage of seroconversion of the vaccinated subjects is shown. In most of the cases more than 80% of the vaccinated subjects showed a more than 2fold increase in RBD-specific antibodies compared to baseline on day 43. In the 8 µg and the 12 µg groups more than 80% of the subjects showed a more than 4fold increase in antibodies.

In FIG. 13G induction of virus neutralizing antibodies is shown. All dose groups showed good induction of virus neutralizing titers wherein the highest dose of 12 µg induced the same level of neutralizing antibodies as present in seroconverted patients (HCS). In the table of FIG. 13G percentage of seroconversion of the vaccinated subjects is shown. In all dose groups more than 70% of the vaccinated subjects showed a more than 2fold increase in virus neutralizing antibodies compared to baseline on day 43. In the 8 µg and 12 µg dose groups at least 70% of the vaccinated subjects showed a more than 4fold increase in virus neutralizing antibodies compared to baseline. In the 12 µg even 100% of the subjects showed a more than 4fold increase in virus neutralizing antibodies.

In FIG. 13H the ratios of the level of Spike protein or RBD binding antibodies to the level of neutralizing antibodies are shown. Importantly, the CVnCoV induced ratio is about the same as from convalescent subjects, which implies that the induced level of antibodies is sufficient to neutralize SARS-CoV-2.

FIG. 13I shows induction of CD4+ T cells against Spike protein S1 after the first dose (day 29) and the second dose (day 36). Both dose groups (4 µg and 8 µg) show good induction of CD4+ T cells against Spike protein S1.

FIG. 13J shows induction of CD4+ T cells against Spike protein S2 after the first dose (day 29) and the second dose (day 36). Both dose groups (4 µg and 8 µg) show good induction of CD4+ T cells against Spike protein S comparable to convalescent patients.

In FIG. 13K induction of virus neutralizing titers in SARS-CoV-2 seropositive subjects (upper part) after vaccination with 2 µg (left) and 4 µg (right) CvnCoV is shown. Remarkably, virus neutralizing antibodies could be boosted in both dose groups in seropositive patients already expressing virus neutralizing antibodies.

In the lower part induction of RBD specific antibodies in SARS-CoV-2 seropositive subjects after vaccination with 2 µg (left) and 4 µg (right) CvnCoV is shown. Remarkably, RBD specific antibodies could be boosted in both dose groups in seropositive patients already expressing RBD specific antibodies.

Example 11: Vaccination of Mice with mRNA Encoding SARS-CoV-2 Antigen S_Stab Formulated in LNPs The present example shows that SARS-CoV-2 S mRNA vaccines with mRNA comprising alternative forms of the 3' end (A64-N5-C30-hSL-N5 or hSL-A100) and UTR combinations (i-3 (−/muag) or a-1 (HSD17B4/PSMB3)) induce strong humoral as well as cellular immune response in mice. mRNA encoding SARS-CoV-2 S_stab comprising hSL-A100 and the UTR combination a-1 (HSD17B4/PSMB3) shows stronger induction of immune responses, demonstrated by a stronger induction of binding and neutralizing antibodies as well as by a stronger induction of CD8+ T-cells.

Preparation of LNP Formulated mRNA Vaccine:

SARS-CoV-2 S mRNA constructs are prepared as described in Example 1 (RNA in vitro transcription). HPLC purified mRNA was formulated with LNPs according to Example 1.4.

Immunization:

Female BALB/c mice (6-8 weeks old, n=8) were injected intramuscularly (i.m.) with mRNA vaccine compositions at dosages indicated in Table 16. As a negative control, one group of mice was vaccinated with buffer. All animals were vaccinated on day 0 and 21. Blood samples were collected on day 21 (post prime) and 42 (post boost) for the determination of antibody titers, splenocytes were isolated on day 42 for T-cell analysis.

Determination of IgG1 and IgG2 antibody titers using ELISA, determination of virus neutralizing titers via CPE (cytopathic effect) and T-cell analysis by Intracellular cytokine staining (ICS) was performed as described in Example 6.

Results:

As shown in FIG. 14A the vaccination with mRNA encoding full length S stabilized protein (S_stab) induced high titers of S specific binding antibody (IgG1 and IgG2a) after a single vaccination (d21). The titers increased after a second vaccination (d42). Vaccine composition comprising mRNA encoding SARS-CoV-2 S_stab comprising hSL-A100 and the UTR combination a-1 (HSD17B4/PSMB3) (group C) showed an improved and stronger induction of binding antibodies (shown by IgG1 and IgG2a endpoint titers).

Both mRNA designs induced more or less comparable virus neutralization antibody titers after second vaccination (day 42), whereas mice of group C showed an early increased level of VNTs already on d21 after first vaccination compared to group B (shown in FIG. 14B).

As shown in FIG. 14C the vaccination with mRNA encoding full length S stabilized protein with both alternative forms of the 3' end (A64-N5-C30-hSL-N5 or hSL-A100) and UTR combinations (i-3 (−/muag) or a-1 (HSD17B4/PSMB3)) induced robust levels of antigen-specific CD4+ and CD8+ IFNγ/TNF double positive T cells after two vaccinations. Vaccine composition comprising mRNA encoding SARS-CoV-2 S_stab comprising hSL-A100 and the UTR combination a-1 (HSD17B4/PSMB3) (group C) showed surprisingly a remarkable stronger induction of CD8+ IFNγ/TNF double positive T cells.

Example 12: Vaccination of Rats with mRNA Encoding SARS-CoV-2 Antigen S_Stab Formulated in LNPs The present example shows that SARS-CoV-2 S mRNA vaccines with mRNA comprising the inventive alternative form of the 3' end (hSL-A100) and UTR combination (a-1 (HSD17B4/PSMB3)) induce strong humoral immune response in rats.

Preparation of LNP Formulated mRNA Vaccine:

SARS-CoV-2 S mRNA constructs are prepared as described in Example 1 (RNA in vitro transcription). HPLC purified mRNA was formulated with LNPs according to Example 1.4 prior to use in in vivo vaccination experiments.

TABLE 16

| Vaccination regimen (Example 11): | | | | | | | |
|---|---|---|---|---|---|---|---|
| Group | Vaccine composition | mRNA ID | CDS opt. | 5'-UTR/3'-UTR; UTR Design | 3'-end | SEQ ID NO: Protein | SEQ ID NO: RNA | Dose |
| A | buffer | — | — | — | — | — | — | — |
| B | mRNA encoding S_stab formulated in LNPs | R9515 | opt1 | —/muag; | A64-N5-C30-hSL-N5 | 10 | 163 | 1 µg |
| C | mRNA encoding S_stab formulated in LNPs | R9709 | opt1 | HSD17B4/PSMB3 | hSL-A100 | 10 | 149 | 1 µg |

Immunization:

Rats were injected intramuscularly (i.m.) with mRNA vaccine compositions and doses as indicated in Table 17. As a negative control, one group of rats was vaccinated with buffer (group A). All animals were vaccinated on day 0 and day 21. Blood samples were collected on day 21 (post prime) and 42 (post boost) for the determination of antibody titers.

TABLE 17

Vaccination regimen (Example 12):

| Group | Vaccine composition | mRNA ID | CDS opt. | 5'-UTR/3'-UTR; UTR Design | 3'-end | SEQ ID NO: Protein | SEQ ID NO: RNA | Dose |
|---|---|---|---|---|---|---|---|---|
| A | buffer | — | — | | | — | — | — |
| B | mRNA encoding S_stab formulated in LNPs | R9709 | opt1 | HSD17B4/ PSMB3 | hSL-A100 | 10 | 149 | 0.5 µg |
| C | mRNA encoding S_stab formulated in LNPs | R9709 | opt1 | HSD17B4/ PSMB3 | hSL-A100 | 10 | 149 | 2 µg |
| C | mRNA encoding S_stab formulated in LNPs | R9709 | opt1 | HSD17B4/ PSMB3 | hSL-A100 | 10 | 149 | 8 µg |

Determination of IgG1 and IgG2 Antibody Titers Using ELISA:

ELISA was performed using recombinant SARS-CoV-2 S (receptor binding domains RBD) protein for coating. Coated plates were incubated using respective serum dilutions, and binding of specific antibodies to SARS-CoV-2 S were detected directly with labeled HRP antibody instead of a secondary HRP antibody used for mouse ELISA. The lack of signal amplification in rat ELISA might account for lower titers, therefore ELISA titers between rat and mouse studies are currently not comparable.

Determination of Virus Neutralizing Antibody Titers (VNT)

Virus neutralizing antibody titers (VNT) of rat serum samples were analyzed as previously described in Example 6 with mouse serum.

Results:

As shown in FIG. 15A the vaccination with mRNA full length S stabilized protein comprising the alternative non-coding region with 3' end hSL-A100 and the UTR combination a-1 (HSD17B4/PSMB3) formulated in LNPs induced in rats robust and dose dependent levels of binding antibody titers at day 21 after first vaccination and at day 42 after second vaccination using doses of 0.5 µg, 2 µg and 8 µg. The second vaccination led to a further increase of antibody titers.

As shown in FIG. 15B vaccination with mRNA comprising the alternative and inventive non-coding region with 3' end hSL-A100 and the UTR combination a-1 (HSD17B4/PSMB3) encoding full length S stabilized protein and formulated in LNPs induced in rats dose dependent and very high levels of VNT. The humoral immune responses shown by ELISA (binding antibodies IgG1 and IgG2a) and VNTS are remarkably increased compared to the immune responses elicited with mRNA comprising non-coding region with 3' end A64-N5-C30-hSL-N5 and UTR combination i-3 (–/muag) (see for comparison Example 8 FIG. 11A-F).

Example 13: Clinical Development of SARS-CoV-2 (CVnCoV) Vaccine

1 Trial Protocol for Human Vaccination
2 Summary

The trial is designed as a Phase 2b/3 pivotal efficacy and safety trial in adults 18 years of age and older. The trial will have a randomized, observer-blinded, placebo-controlled design. Subjects will be enrolled at multiple sites globally and will be randomized in a 1:1 ratio to receive a 2-dose schedule of either CVnCoV at a dose level of 12 µg mRNA or placebo {normal saline (0.9% NaCl)} as the control.

3 Extension

Following completion of Trial CV-NCOV-004 on Day 393, subjects will continue to participate in a 1 year extension of the trial. At the time of consent for Trial CV-NCOV-004, subjects will also be consented for participation in the 1 year extension. The Extension Study will collect additional data to evaluate long term safety {serious adverse events (SAEs)}, persistence of antibodies to SARS-CoV-2, and the occurrence of COVID-19 cases to assess duration of vaccine efficacy (VE).

4 Trial Objectives, Endpoints, and Estimands
4.1 Objectives
4.1.1 Primary Objectives
Co-Primary Efficacy Objectives To demonstrate the efficacy of a 2-dose schedule of CVnCoV in the prevention of first episodes of virologically-confirmed cases of COVID-19 of any severity in SARS CoV 2 naïve subjects.

To demonstrate the efficacy of a 2-dose schedule of CVnCoV in the prevention of first episodes of virologically-confirmed moderate to severe cases of COVID-19 in SARS CoV-2 naïve subjects.

Primary Safety Objective

To evaluate the safety of CVnCoV administered as a 2-dose schedule to subjects 18 years of age and older.
4.1.2 Secondary Objectives
Key Secondary Efficacy Objectives To demonstrate the efficacy of a 2-dose schedule of CVnCoV in the prevention of first episodes of virologically-confirmed severe cases of COVID-19 in SARS-CoV-2 naïve subjects.

To demonstrate the efficacy of a 2-dose schedule of CVnCoV in the prevention or reduction of asymptomatic infection by SARS-CoV-2 in seronegative subjects, as measured by seroconversion to the N protein of the virus.

Other Secondary Efficacy Objectives
To evaluate in SARS-CoV-2 naïve subjects:

The efficacy of a 2-dose schedule of CVnCoV in the prevention of first episodes of virologically-confirmed cases of COVID-19 of any severity in subjects≥61 years of age.

The efficacy of a 2-dose schedule of CVnCoV in the prevention of first episodes of virologically-confirmed cases of SARS-CoV-2 infection, with or without symptoms.

The efficacy of a 2-dose schedule of CVnCoV in reducing the Burden of disease (BoD) from COVID-19.

The efficacy of CVnCoV after the first dose in the prevention of first episodes of virologically-confirmed cases of COVID-19 of any severity.

Secondary Immunogenicity Objectives

To assess antibody responses to the RBD of S protein of SARS-CoV-2 after 1 and 2 doses of CVnCoV in a subset of subjects participating in Phase 2b of the trial.

To assess SARS-CoV-2 viral neutralizing antibody responses after 1 and 2 doses of CVnCoV in a subset of subjects participating in Phase 2b of the trial.

Secondary Safety Objective

To evaluate the reactogenicity and tolerability of CVnCoV administered as a 2-dose schedule to subjects 18 years of age and older participating in Phase 2b of the trial.

4.1.3 Exploratory Objectives

Exploratory Efficacy Objectives

To investigate in SARS-CoV-2 naïve subjects:

If cases of COVID-19 are milder in severity in subjects receiving a 2-dose schedule of CVnCoV compared to those administered placebo.

If the need for supplemental oxygenation due to COVID-19 is reduced in subjects receiving a 2-dose schedule of CVnCoV compared to those administered placebo.

If the need for mechanical ventilation due to COVID-19 is reduced in subjects receiving a 2-dose schedule of CVnCoV compared to those administered placebo.

If hospitalization due to COVID-19 is reduced in subjects receiving a 2-dose schedule of CVnCoV compared to those administered placebo.

If mortality due to COVID-19 is reduced in subjects receiving a 2-dose schedule of CVnCoV compared to those administered placebo.

If all-cause mortality is reduced in subjects receiving a 2-dose schedule of CVnCoV compared to those administered placebo.

To investigate the cell-mediated immune (CMI) response of a 2-dose schedule of CVnCoV from up to 400 subjects at selected site(s).

To investigate in SARS-CoV-2 naïve and non-naïve subjects:

The efficacy of a 2-dose schedule of CVnCoV in the prevention of first episodes of virologically-confirmed cases of COVID-19 of any severity in all subjects, regardless of SARS-CoV-2 serological status at baseline.

The efficacy of CVnCoV after the first dose in the prevention of first episodes of virologically-confirmed cases of COVID-19 of any severity in all subjects, regardless of SARS-CoV-2 serological status at baseline.

To investigate in subjects with first episodes of virologically-confirmed COVID-19 during the trial:

The occurrence of second episodes of COVID-19 in subjects receiving a 2-dose schedule of CVnCoV compared to those administered placebo.

4.2 Endpoints 4.2.1 Primary Endpoints

Co-Primary Efficacy Endpoints

Occurrence of first episodes of virologically-confirmed {reverse transcription polymerase chain reaction (RT-PCR) positive} cases of COVID-19 of any severity meeting the case definition for the primary efficacy analysis.

Occurrence of first episodes of virologically-confirmed (RT-PCR positive) cases of moderate to severe COVID-19 meeting the case definition for the primary efficacy analysis (moderate and severe COVID-19 disease defined herein).

Primary Safety Endpoints

Occurrence, intensity and relationship of medically-attended AEs collected through 6 months after the second trial vaccination in all subjects.

Occurrence, intensity and relationship of SAEs and AESIs collected through 1 year after the second trial vaccination in all subjects.

Occurrence of fatal SAEs through 1 year after the second trial vaccination in all subjects.

4.2.2 Secondary Endpoints

Key Secondary Efficacy Endpoints

Occurrence of first episodes of virologically-confirmed (RT-PCR positive) severe cases of COVID-19 meeting the case definition for the primary efficacy analysis (severe COVID-19 disease defined in herein).

Occurrence of seroconversion to the N protein of SARS-CoV-2≥15 days following the second trial vaccination in asymptomatic seronegative subjects.

Seroconversion is defined as detectable SARS-CoV-2 N protein antibodies in the serum of subjects on Day 211 and/or Day 393 of the trial, who tested seronegative at Day 1 (baseline) and Day 43 (i.e. at the 2 testing time points prior to 15 days following the second trial vaccination).

Other Secondary Efficacy Endpoints

In subjects≥61 years of age, occurrence of first episodes of virologically-confirmed (RT-PCR positive) cases of COVID-19 of any severity meeting the case definition for the primary efficacy analysis.

Occurrence of virologically-confirmed (RT-PCR positive) SARS-CoV-2 infection, with or without symptoms.

If subject was symptomatic, onset of symptoms must have occurred≥15 days following the second trial vaccination; if subject was asymptomatic, the positive RT PCR test must have occurred≥15 days following the second trial vaccination.

BoD scores calculated based on first episodes of virologically-confirmed (RT-PCR positive) cases of COVID-19 of any severity meeting the case definition for the primary efficacy analysis.

BoD #1—no disease (not infected or asymptomatic infection)=0; mild or moderate disease=1; severe disease=2.

BoD #2—no disease (not infected or asymptomatic infection)=0; disease without hospitalization=1; disease with hospitalization=2; death=3.

Occurrence of first episodes of virologically-confirmed (RT-PCR positive) cases of COVID-19 of any severity with symptom onset at any time after the first trial vaccination.

Secondary Immunogenicity Endpoints (Phase 2b Immunogenicity Subset)

SARS-CoV-2 RBD of S Protein Antibody Responses

On Days 1, 29, 43, 57, 120, 211 and 393:

Serum antibodies to SARS-CoV-2 RBD of S protein.

Occurrence of seroconversion to SARS-CoV-2 RBD of S protein.

Seroconversion is defined as detectable SARS-CoV-2 RBD of S protein antibodies in the serum of subjects who tested seronegative at baseline.

SARS-CoV-2 Viral Neutralizing Antibody Responses

On Days 1, 29, 43, 57, 120, 211, and 393:

Serum viral neutralizing antibodies to SARS-CoV-2 virus, as measured by a viral neutralizing antibody assay.

Occurrence of seroconversion to SARS-CoV-2 virus, as measured by a viral neutralizing antibody assay.

Seroconversion is defined as detectable SARS-CoV-2 viral neutralizing antibodies in the serum of subjects who tested seronegative at baseline.

Secondary Safety Endpoints

Occurrence, intensity and duration of each solicited local AE within 7 days after each trial vaccination in Phase 2b subjects.

Occurrence, intensity, duration of each solicited systemic AE within 7 days after each trial vaccination in Phase 2b subjects.

Occurrence, intensity and relationship of unsolicited AEs occurring within 28 days after each trial vaccination in Phase 2b subjects.

Occurrence of AEs leading to vaccine withdrawal or trial discontinuation through 1 year after the second trial vaccination in all subjects.

4.2.3 Exploratory Endpoints

Exploratory Efficacy Endpoints

Severity assessment of first episodes of virologically-confirmed (RT-PCR positive) cases of COVID-19 meeting the case definition for the primary efficacy analysis.

The following endpoints will be analyzed as occurring≥15 days following the second trial vaccination (full VE) and at any time after the first trial vaccination.

In SARS-CoV-2 naïve subjects:

Occurrence of supplemental oxygenation due to COVID-19 disease.

Occurrence of mechanical ventilation due to COVID-19 disease.

Occurrence of hospitalization due to COVID-19 disease.

Occurrence of death due to COVID-19 disease.

Occurrence of death due to any cause.

In SARS-CoV-2 naïve and non-naïve subjects:

In all subjects regardless of their baseline serostatus, occurrence of first episodes of virologically-confirmed (RT-FOR positive) cases of COVID-19 of any severity.

The following endpoint will be analyzed in subjects who had a first episode of a virologically-confirmed (RT-PCR positive) case of COVID-19 of any severity meeting the case definition for the primary efficacy analysis.

Occurrence of second episodes of virologically-confirmed (RT-PCR positive) cases of COVID-19 of any severity.

Exploratory Immunogenicity Endpoints (Phase 2b Immunogenicity Subset)

On Days 1, 29, 43, 120*, and 211** in peripheral blood mononuclear cells (PBMCs) from up to 400 subjects at selected site(s):

The frequency and functionality of SARS-CoV-2 RBD of S-specific T-cell response after antigen stimulation by intracellular cytokine staining (ICS) to investigate Th response and expression of Th2 markers.

The proportion of subjects with a detectable increase in SARS-CoV 2 RBD of S specific T cell response.

**Testing of samples collected on Day 120 and Day 211 will be done only in subjects categorized as T-cell responders on Day 29 and/or Day 43.

4.3 Estimands

| ENDPOINTS (subject level) | ESTIMANDS (population level) |
|---|---|
| Co-Primary Efficacy | |
| Occurrence of first episodes of virologically-confirmed (RT-PCR positive) cases of COVID-19 of any severity meeting the case definition for the primary efficacy analysis. Occurrence of first episodes of virologically-confirmed (RT-PCR positive) cases of moderate to severe COVID-19 meeting the case definition for the primary efficacy analysis. | In naïve evaluable subjects (complying with the definition of Efficacy Analysis Set) at least 15 days following second vaccination: VE = 1- RR with exact 97.5% CI Where RR (relative risk) is the ratio of attack rates of COVID-19 cases per 100 person-month in the CVnCoV vaccine group over the placebo group. |
| Primary Safety | |
| Occurrence, intensity and relationship of medically-attended AEs collected through 6 months after the second trial vaccination in all subjects. Occurrence, intensity and relationship of SAEs and AESIs collected through 1 year after the second trial vaccination in all subjects. Occurrence of fatal SAEs through 1 year after the second trial vaccination in all subjects. | In subjects who received at least one dose of CVnCoV or placebo vaccine, the number and percentage of subjects by group reporting at least 1 and at each type (by SOC/PT) of: Medically-attended AE in the 6 months after the last vaccination overall, by intensity and by causal relationship to trial vaccine. SAE in the year after the last vaccination overall and by causal relationship to trial vaccine. AESI in the year after the last vaccination overall, by intensity and by causal relationship to trial vaccine. Fatal SAE in the year after the last vaccination. |
| Key Secondary Efficacy | |
| Occurrence of first episodes of virologically-confirmed (RT-PCR positive) severe cases of COVID-19 meeting the case definition for the primary efficacy analysis. | In naïve evaluable subjects (complying with the definition of Efficacy Analysis Set) at least 15 days following second vaccination: VE = 1- RR with exact 95% CI Where RR (relative risk) is the ratio of attack rates of severe COVID-19 cases per 100 person-month in the CVnCoV vaccine group over the placebo group. |
| Occurrence of seroconversion to the N protein of SARS-CoV-2 ≥ 15 days following the second trial vaccination in asymptomatic seronegative subjects. Seroconversion is defined as detectable SARS-CoV-2 N protein antibodies in the serum of subjects on Day 211 and/or Day 393 of the trial, who tested seronegative at Day 1 (baseline) and Day 43 (i.e. at the 2 testing time points prior to 15 days following the second trial vaccination). | In naïve evaluable subjects (complying with the definition of Efficacy Analysis Set) who tested seronegative at baseline and Day 43 for the N protein of SARS-COV-2 and with at least 1 of Day 211 or Day 393 serology done: VE = 1- RR with exact 95% CI Where RR (relative risk) is the ratio of attack rates of Asymptomatic infections (Seroconversion to the N protein at Day 211 and then seroconversion to the N protein at either Day 211 or Day 393) in the CVnCoV vaccine group over the placebo group. |

| ENDPOINTS (subject level) | ESTIMANDS (population level) |
|---|---|
| Other Secondary Efficacy | |
| In subjects ≥ 61 years of age, occurrence of first episodes of virologically-confirmed (RT-PCR positive) cases of COVID-19 of any severity meeting the case definition for the primary efficacy analysis. | In naïve evaluable subjects ≥ 61 years of age at randomization (complying with the definition of Efficacy Analysis Set) at least 15 days following second vaccination:<br>VE = 1- RR with exact 95% CI<br>Where RR (relative risk) is the ratio of attack rates of COVID-19 cases per 100 person-month in the CVnCoV vaccine group over the placebo group. |
| Occurrence of virologically-confirmed (RT-PCR positive) SARS-CoV-2 infection, with or without symptoms.<br>If subject was symptomatic, onset of symptoms must have occurred ≥ 15 days following the second trial vaccination; if subject was asymptomatic, the positive RT-PCR test must have occurred ≥ 15 days following the second trial vaccination.<br>BoD scores calculated based on first episodes of virologically-confirmed (RT-PCR positive) cases of COVID-19 of any severity meeting the case definition for the primary efficacy analysis.<br>BoD #1 - no disease (not infected or asymptomatic infection) = 0; mild or moderate disease = 1; severe disease = 2.<br>BoD #2 - no disease (not infected or asymptomatic infection) = 0; disease without hospitalization = 1; disease with hospitalization = 2; death = 3. | In naïve evaluable subjects (complying with the definition of Efficacy Analysis Set) at least 15 days following second trial vaccination:<br>VE = 1- RR with exact 95% CI<br>Where RR (relative risk) is the ratio of attack rates of virologically-confirmed (RT-PCR positive) SARS-CoV-2 infection per 100 person-month in the CVnCoV vaccine group over the placebo group.<br>In naïve evaluable subjects (complying with the definition of Efficacy Analysis Set) at least 15 days following second trial vaccination:<br>VE = 1- RR with exact 95% CI<br>Where RR (relative risk) is the ratio of attack rates of virologically-confirmed (RT-PCR positive) SARS-CoV-2 infection per 100 person-month in the CVnCoV vaccine group over the placebo group |
| Occurrence of first episodes of virologically-confirmed (RT-PCR positive) cases of COVID-19 of any severity with symptom onset at any time after the first trial vaccination. | In naïve subjects who received at least one dose of CVnCoV or placebo vaccine at any time after the first vaccination:<br>VE = 1- RR with exact 95% CI<br>Where RR (relative risk) is the ratio of attack rates of COVID-19 cases per 100 person-month in the CVnCoV vaccine group over the placebo group |
| Secondary Immunogenicity | |
| SARS-CoV-2 RBD of S protein antibody responses<br>On Days 1, 29, 43, 57, 120, 211 and 393:<br>Serum antibodies to SARS-CoV-2 RBD of spike (S) protein, as measured by enzyme-linked immunosorbent assay (ELISA).<br>SARS-CoV-2 RBD of S protein antibody responses<br>On Days 1, 29, 43, 57, 120, 211 and 393:<br>Occurrence of seroconversion to SARS-CoV-2 RBD of spike (S) protein, as measured by ELISA.<br>Seroconversion is defined as detectable SARS-CoV-2 RBD of spike (S) protein antibodies in the serum of subjects who tested seronegative at baseline. | In phase 2b subjects belonging to the Immunogenicity subset and evaluable (complying with the definition of per-protocol immunogenicity set):<br>On Days 1, 29, 43, 57, 120, 211 and 393:<br>Geometric mean of titers (GMT) with 95% CI of SARS-CoV-2 RBD of spike (S) protein antibody responses by group and by baseline sero-status and group<br>On Days 29, 43, 57, 120, 211 and 393 for subjects seropositive at baseline:<br>Geometric mean of Fold Change from baseline (GMFC) with 95% CI of SARS-CoV-2 RBD of spike (S) protein antibody responses by group.<br>On Days 29, 43, 57, 120, 211 and 393 for subjects seronegative at baseline:<br>Number and percentage with exact 95% CI of subjects by group for who a seroconversion is observed (detectable SARS-CoV-2 RBD of S protein antibodies in the serum). |
| SARS-CoV-2 viral neutralizing antibody responses (subset of subjects analyzed)<br>On Days 1, 29, 43, 57, 120, 211 and 393:<br>Serum viral neutralizing antibodies to SARS-CoV-2 virus, as measured by a viral neutralizing antibody assay.<br>SARS-CoV-2 viral neutralizing antibody responses (subset of subjects analyzed)<br>On Days 1, 29, 43, 57, 120, 211 and 393:<br>Occurrence of seroconversion to SARS-CoV-2 virus, as measured by a viral neutralizing antibody assay.<br>Seroconversion is defined as detectable SARS-CoV-2 viral neutralizing antibodies in the serum of subjects who tested seronegative at baseline. | In phase 2b subjects belonging to the Immunogenicity subset and evaluable (complying with the definition of per-protocol immunogenicity set):<br>On Days 1, 29, 43, 57, 120, 211 and 393:<br>Geometric mean of titers (GMT) with 95% CI of neutralizing antibodies to SARS-CoV-2 virus by group and by baseline serostatus and group<br>On Days 29, 43, 57, 120, 211 and 393 for subjects seropositive at baseline:<br>Geometric mean of Fold Change from baseline (GMFC) with 95% CI of neutralizing antibodies to SARS-CoV-2 virus by group.<br>On Days 29, 43, 57, 120, 211 and 393 for subjects seronegative at baseline:<br>Number and percentage with exact 95% CI of subjects by group for who a seroconversion is observed (detectable neutralizing antibodies to SARS-CoV-2 virus in the serum). |

| ENDPOINTS (subject level) | ESTIMANDS (population level) |
|---|---|
| Secondary Safety | |
| Occurrence, intensity and duration of each solicited local AE within 7 days after each trial vaccination in Phase 2b subjects. Occurrence, intensity, duration of each solicited systemic AE within 7 days after each trial vaccination in Phase 2b subjects. Occurrence, intensity and relationship of unsolicited AEs occurring within 28 days after each trial vaccination in Phase 2b subjects. Occurrence of AEs leading to vaccine withdrawal or trial discontinuation through 1 year after the second trial vaccination in all subjects. | In phase 2b subjects who received at least one dose of CVnCoV or placebo vaccine: The number and percentage of subjects by group reporting: Each solicited local AE within 7 days (after each trial vaccination by intensity and overall Each solicited systemic AE within 7 days after each trial vaccination by intensity, by relationship to trial vaccine and overall. At least 1 unsolicited AEs, at least 1 grade 3 unsolicited AEs and each unsolicited AEs by SOC/PT occurring within 28 days after each trial vaccination and overall by causal relationship to trial vaccine and overall At least 1 AEs leading to vaccine withdrawal or trial discontinuation in the year after the last trial vaccination The mean duration in days by group with standard deviation of solicited AEs (within the solicited period, total duration). |
| Exploratory Efficacy | |
| Severity assessment of first episodes of virologically-confirmed (RT-PCR positive) cases of COVID-19 meeting the case definition for the primary efficacy analysis | In naïve evaluable subjects (complying with the definition of Efficacy Analysis Set) who had a first episode of a virologically-confirmed (RT-PCR positive) case of COVID-19 of any severity meeting the case definition for the primary efficacy analysis: The proportions of mild and severe COVID-19 cases among all cases by group |
| The following endpoints will be analyzed as occurring ≥ 15 days following the second trial vaccination (full vaccine efficacy) and at any time after the first trial vaccination. Occurrence of supplemental oxygenation due to COVID-19 disease. Occurrence of mechanical ventilation due to COVID-19 disease. Occurrence of hospitalization due to COVID-19 disease. Occurrence of death due to COVID-19 disease. Occurrence of death due to any cause. | In naïve evaluable subjects (complying with the definition of Efficacy Analysis Set) at least 15 days following second vaccination AND In subjects who received at least one dose of CVnCoV or placebo vaccine at any time after the first trial vaccination: Number and percentages by group of subjects who: Need for supplemental oxygenation due to COVID-19. Need for mechanical ventilation due to COVID-19. Hospitalized due to COVID-19. Deceased due to COVID-19. Deceased due to any cause. |
| In all subjects regardless of their baseline serostatus, occurrence of first episodes of virologically-confirmed (RT-PCR positive) cases of COVID-19 of any severity. | In subjects who received at least one dose of CVnCoV or placebo vaccine, at any time after the first trial vaccination: VE = 1- RR with exact 95% CI Where RR (relative risk) is the ratio of attack rates of COVID-19 cases per 100 person-month in the CVnCoV vaccine group over the placebo group |
| The following endpoint will be analyzed in subjects who had a first episode of a virologically-confirmed (RT-PCR positive) case of COVID-19 of any severity meeting the case definition for the primary efficacy analysis. Occurrence of second episodes of virologically-confirmed (RT-PCR positive) cases of COVID-19 of any severity. | In naïve evaluable subjects (complying with the definition of Efficacy Analysis Set) who had a first episode of a virologically-confirmed (RT-PCR positive) case of COVID-19 of any severity meeting the case definition for the primary efficacy analysis, at least 15 days following second vaccination: The number and percentage of subjects who developed a second episode of COVID-19. |
| Exploratory Immunogenicity | |
| On Days 1, 29, 43, 120**, and 211** in peripheral blood mononuclear cells (PBMCs) from up to 400 subjects at selected site(s): The frequency and functionality of SARS-CoV-2 RBD of S-specific T-cell response after antigen stimulation by intracellular cytokine staining (ICS) to investigate Th1 response and expression of Th2 markers. The proportion of subjects with a detectable increase in SARS-CoV-2 RBD of S-specific T-cell response. | Exploratory immunogenicity estimands will be described in the Statistical Analysis Plan, as applicable. |

**Testing of samples collected on Day 120 and Day 211 will be done only in subjects categorized as T-cell responders on Day 29 and/or Day 43.

5 Trial Design 5.1 Overall Design

Trial CV-NCOV-004 will be conducted in 2 parts: an initial Phase 2b trial followed by transition to a large Phase 3 efficacy trial. Both Phase 2b and Phase 3 will be conducted as randomized, observer-blinded, placebo-controlled trials. Subjects 18 years of age or older will be enrolled at multiple sites globally and will receive a 2-dose schedule of either CVnCoV at a dose level of 12 µg mRNA or placebo {normal saline (0.9% NaCl)} in a 1:1 ratio. Both Phase 2b and Phase 3 parts of the trial are consistent in design (e.g., for COVID-19 case ascertainment and case definition) so that cases of COVID-19 occurring in Phase 2b can be pooled with those in Phase 3 for the primary analysis of VE.

Subjects will also participate in a 1-year extension of the Phase 2b and Phase 3 parts of the trial.

Phase 2b Design and Objectives

The objective of Phase 2b is to further characterize the safety, reactogenicity, and immunogenicity of CVnCoV prior to initiating Phase 3. CVnCoV will be administered at the 12 µg dose level selected for Phase 3 investigation informed by the safety and immunogenicity data from the initial Phase 1 and 2a trials. Phase 2b will be conducted in 2 age groups of adults: 18 to 60 and ≥61 years of age, which represent the age range of the intended Phase 3 trial population.

Approximately 4,000 subjects will be enrolled and randomized in a 1:1 ratio to receive 2 doses of either CVnCoV at a dose level of 12 µg mRNA or placebo, administered 28 days apart. Of the 4,000 subjects enrolled, approximately 800 to 1,000 (20% to 25%) will be ≥61 years of age. Phase 2b will be performed in an observer-blinded manner to reduce any potential bias in the safety assessments. The sample size of 4,000 subjects is based on generating a robust and detailed dataset characterizing the safety, reactogenicity, and immunogenicity of CVnCoV prior to entering Phase 3. Furthermore, the data generated in Phase 2b will be the main dataset to be submitted in support of early conditional approval of CVnCoV.

In Phase 2b, the safety and reactogenicity of a 2-dose schedule of CVnCoV will be assessed in detail by measuring the frequency and severity of the following AEs: solicited local and systemic reactions for 7 days after each vaccination; unsolicited AEs for 28 days after each vaccination; medically-attended AEs through 6 months after the second trial vaccination; and AESIs and SAEs through 1 year after the second trial vaccination. The immunogenicity of CVnCoV will be evaluated after 1 and 2 doses in a subset of subjects (first 600 subjects enrolled in each of the 2 age groups; a total of 1,200 subjects in the Immunogenicity Subset) by measuring binding antibodies to the SARS-CoV-2 RBD of S protein and viral neutralizing antibodies. Antibody persistence will be evaluated in this trial as well as in the Extension Study.

Cases of COVID-19 occurring in Phase 2b subjects will be collected and pooled with those occurring in Phase 3 and the total number of cases will be used for the primary analysis of efficacy. In addition, the DSMB will periodically monitor COVID-19 cases for signals of VDE.

Subjects participating in Phase 2b will also be evaluated for asymptomatic SARS-CoV-2 infection during the trial, as measured by the development of antibodies to the N protein of SARS-CoV-2 (i.e. seroconversion). These data will be combined with those from Phase 3 to determine if vaccination with CVnCoV can prevent or reduce the rate of asymptomatic infection by SARS-CoV-2 (one of the key secondary efficacy objectives).

Initiation of subject enrollment of the 2 target age groups into Phase 2b will be flexible. Depending on the timing of data from the Phase 1 and Phase 2a trials, enrollment of the 2 age groups into Phase 2b may be staggered, initially starting with subjects 18 to 60 years of age followed by subjects≥61 years of age. As the older age group will comprise 20% to 25% of the total number of subjects in Phase 2b, this staggered start is not expected to impact overall enrollment of the Phase 2b cohort.

An early safety review of the Phase 2b data will be performed by the DSMB (see Section 9.3.9.1). The safety review will be conducted when approximately 1,000 subjects have been enrolled in Phase 2b (25% of subjects enrolled; 500 recipients of CVnCoV and 500 recipients of placebo) and have at least 1 week of safety follow-up after the first trial vaccination. If the safety profile is judged to be acceptable and there are no safety or tolerability concerns, it is anticipated that enrollment of subjects into Phase 3 can begin without interruption from Phase 2b. Another safety review by the DSMB will be conducted when approximately 1,000 Phase 2b subjects have received their second trial vaccination and have at least week of safety follow-up. All available first dose safety data from the Phase 2b subjects will also be reviewed at this time.

Phase 3 Design and Objectives

The co-primary objectives of the combined Phase 2b/3 trial are to demonstrate the efficacy of a 2-dose schedule of CVnCoV in the prevention of COVID-19 cases of any severity or COVID-19 cases of moderate or higher severity. Similar to Phase 2b, Phase 3 will be conducted as a randomized, observer-blinded, placebo controlled trial. Approximately 32,500 subjects, 18 years of age or older, will be enrolled at multiple sites globally in Phase 3 and will receive a 2-dose schedule of either CVnCoV at the 12 µg dose level or placebo in a 1:1 ratio (see FIG. 2). Similar to Phase 2b, enrollment will target subjects≥61 years of age to be approximately 20% to 25% of the Phase 3 trial population (6,500 to 8,125 subjects). The total enrollment of the combined Phase 2b and Phase 3 parts of the trial will be 36,500 subjects.

Subjects will undergo active surveillance for COVID-19. During all site visits and phone calls, subjects will be reminded to contact the site if they have an acute illness with any symptoms clinically consistent with COVID-19. In addition, subjects will be messaged up to twice a week and will provide a yes or no response to having COVID-19 symptoms. Those who respond "yes" will be contacted by trial staff for a follow-up interview and assessment. If a subject is suspected of having COVID-19 illness, he/she will undergo testing for SARS-CoV-2 infection with samples collected at the site or at a home visit. If the subject is confirmed to have COVID-19, all subjects will be followed until resolution of their disease. If the subject is hospitalized, the subject's progress must continue to be followed by the Investigator and a discharge summary obtained at the end of the hospitalization. Information on clinical symptoms and signs, their duration and severity, and treatment and outcome of the COVID-19 episode will be documented by trial staff and recorded in the electronic case report form (eCRF). Upon resolution, subjects will continue to be followed through the trial end in the same manner as those who have not presented with COVID-19. A second episode of COVID-19 in a subject with prior disease will not be counted as a primary efficacy case, but will be counted for the exploratory objective assessing the reoccurrence of COVID-19 in vaccinated subjects.

Due to the uncertain incidence rate of COVID-19 cases in a pandemic setting, the trial will be conducted as a case-driven trial based on the any severity COVID-19 endpoint, which will include a two interim analyses and a final analysis both triggered by achieving a predefined number of cases for each analysis. As described above, cases of COVID-19 occurring in Phase 2b will be pooled with those in Phase 3 for the primary analysis of VE. As such, subjects participating in Phase 2b will contribute to the total sample size for the primary analysis of VE (N=36,500).

For the primary analysis of efficacy, the case must meet the following criteria (moderate and severe COVID-19 disease is defined herein):

Must be a virologically-confirmed case of COVID-19 defined as a positive SARS CoV 2 specific RT-PCR test in a person with clinically symptomatic COVID-19 (see Section 9.2).

Symptom onset must have occurred≥15 days following the second trial vaccination.

The subject must not have a history of virologically-confirmed COVID-19 at enrollment (based on exclusion criterion 1) or have developed a case of virologically-confirmed COVID-19 before 15 days following the second trial vaccination.

The subject must have been demonstrated to be SARS-CoV-2 naïve at baseline and at Day 43 (seronegative to N protein).

Primary efficacy cases must be confirmed by the Adjudication Committee.

This trial will utilize a group sequential design with 2 interim analyses for high efficacy or futility using the O'Brien and Fleming error spending function for the co-primary endpoint of virologically-confirmed COVID-19 cases of any severity. With an overall 2-sided alpha of 2.5% and a total of 185 COVID-19 cases of any severity meeting the primary efficacy case definition at the final analysis, the trial will have an overall power of 90% to demonstrate a VE greater than 30% {based on a margin of 30% for the lower bound of the 97.5% confidence interval (CI) for VE} when considering VE is 60%. Two interim analyses of high efficacy or futility will be performed once 56/111 cases meeting the primary case definition have been accrued (30%/60% of final case number). These points were chosen based on 2 criteria: i) the robustness of 56/111 cases to support the decision of high efficacy or futility and ii) if high efficacy, this would shorten the duration of the trial and potentially allow the vaccine to be available earlier.

For the co-primary endpoint of virologically-confirmed moderate to severe COVID-19 cases, with an overall 2-sided alpha of 2.5% and a total of 60 severe to moderate COVID 19 cases meeting the primary efficacy case definition at the final analysis, the trial will have an overall power of 90% to demonstrate a VE greater than 20% {based on a margin of 20% for the lower bound of the 97.5% confidence interval (CI) for VE} when considering VE is 70%. Assuming that ⅓ of COVID-19 cases are moderate to severe, 60 moderate to severe cases will be obtained when the total number of COVID-19 cases is 180. There will be no interim analysis for this co-primary endpoint. Assuming an incidence rate of COVID-19 of 0.15% per month (1.5 cases/1000/month) in placebo subjects; a VE of 60%; and a non-evaluable rate of 20% during the trial which includes ~5% seropositivity of enrollees at baseline (i.e. non-naïve subjects), follow-up of 36,500 subjects enrolled over 3 months (18,250 per vaccine group) will accrue the target 185 COVID-19 cases of any severity approximately 9 months after the first vaccination.

At or near the completion of enrollment, an unblinded review of the incidence rate of cases will be performed by the DSMB. If the case accrual rate is lower than expected, the DSMB may recommend an increase in sample size. If needed, another unblinded review by the DSMB may be performed later in the trial to further adjust the sample size. The trial events are shown in the timeline below (the 1-year Extension Study is discussed below).

With an equal follow-up time of evaluable subjects in both groups, efficacy would be demonstrated at the final analysis if 60 cases or less of the 185 total cases are in the CVnCoV group (estimated VE≥52.0%). Two interim analyses for high efficacy or futility will be performed when 56/111 cases meeting the primary case definition have been accrued (approximately 5/6.5 months after trial start). If the follow-up time of evaluable subjects is equal in both groups, early high efficacy would be demonstrated if 7/29 cases or less of the 56/111 cases are in the CVnCoV group (estimated VE at interim≥85.7%/64.6%); conversely, futility would be reached if 26/41 cases or more are in the CVnCoV group (estimated VE at interim≤13.3%/41.4%). The assessment of the interim analyses will be performed by the DSMB and the outcome will be communicated without unblinding the Trial Team or the Sponsor.

Similar to Phase 2b, subjects participating in Phase 3 will be evaluated for SARS-CoV-2 infection during the trial, as measured by the development of antibodies to the N protein of SARS-CoV-2 in seronegative subjects.

The safety objective of Phase 3 is to generate a large-scale safety database that will demonstrate the safety of CVnCoV. All subjects participating in the Phase 2b and Phase 3 parts of the trial will have medically-attended AEs collected for 6 months after the second vaccination; and AESIs and SAEs collected for 1 year after the second vaccination.

Independent of the demonstration of CVnCoV efficacy at either of the interim analyses or at the final analysis, HERALD Trial CV-NCOV-004 will continue and remain observer blinded until the end of the trial {when the last subject has completed the last visit on Day 393 (see Section 5.4)}. During this period, collection of placebo-controlled safety data and accrual of COVID-19 cases will continue.

Extension Study

Following completion of the trial on Day 393, subjects will continue participating in the 1 year (12-month) extension of HERALD Trial CV-NCOV-004. During the Extension Study, blinding at the site level will be maintained for the collection of additional placebo controlled data for safety (SAEs), persistence of antibodies to SARS-CoV-2, and occurrence of COVID-19 cases to assess duration of efficacy. The Extension Study may be terminated upon approval of CVnCoV, at which time control subjects may be offered vaccination with CVnCoV as soon as feasible. The Extension Study may also be terminated upon deployment of an effective vaccine locally. Before terminating the Extension Study, this will be discussed with the DSMB and Investigators as well as with the relevant regulatory agencies.

5.2 Scientific Rationale for Trial Design

HERALD Trial CV-NCOV-004 will be conducted in 2 parts: an initial Phase 2b trial followed by transition to a large Phase 3 efficacy trial. Both Phase 2 and Phase 3 parts of the trial are consistent in design, so that cases of COVID-19 occurring in Phase 2 can be pooled with those in Phase 3 for the primary analysis of VE. Combining COVID-19 cases in Phase 2 and 3 to expedite an efficacy outcome was considered warranted in a pandemic setting.

Both Phase 2b and Phase 3 will be randomized, observer-blinded, and placebo-controlled. The difference in appearance and presentation of the investigational CVnCoV vaccine and placebo requires the trial to be conducted in an observer-blinded manner, which is a commonly used and well-accepted method for trial blinding. The randomized, observer blinded, and placebo-controlled design will reduce the risk of bias in the safety and efficacy outcomes of the trial (see also Section 7.3).

As the elderly are affected most by SARS CoV 2 and have a high risk for severe disease and mortality, it is critical to investigate CVnCoV in this population and therefore subjects≥61 years of age will be included.

The sample size of 4,000 subjects in Phase 2b is based on generating a robust and detailed dataset characterizing the safety, reactogenicity, and immunogenicity of CVnCoV prior to entering Phase 3. Furthermore, the data generated in Phase 2b will be the main dataset to be submitted in support of early conditional approval of CVnCoV. The total sample size of 36,500 subjects for the combined Phase 2b/3 trial is based on demonstrating VE above 30% (based on a margin of 30% for the lower bound of the 97.5% CI for VE) when considering VE is 60%. With a 2-sided alpha of 2.5% and a total of 185 COVID-19 cases, the trial will have a 90% power to demonstrate a VE above 30%. Assuming an incidence rate of COVID-19 of 0.15% per month in control subjects; and a non-evaluable rate of 20% during the trial which includes 5% seropositivity of enrollees at baseline (i.e. non-naïve subjects), follow-up of 36,500 subjects enrolled over 3 months (18,250 per vaccine group) will accrue the target 185 COVID-19 cases approximately 9 months after the first vaccination.

For the co-primary analyses of efficacy, COVID-19 case ascertainment begins at ≥15 days following the second vaccination of CVnCoV. This time point allows the immune response to mature and reach its full height following the second dose. As such, case ascertainment starting at this time point represents the evaluation of full VE of CVnCoV against COVID 19.

The safety objective of Phase 3 is to generate a large-scale safety database that will demonstrate the safety of CVnCoV. All subjects participating in the Phase 2b and Phase 3 parts of the trial will have medically-attended AEs collected for 6 months after the second vaccination; and AESIs and SAEs collected for 1 year after the second vaccination. As such, each subject will participate in the trial for approximately 13.5 months for the safety follow-up. Individuals with history of virologically-confirmed COVID-19 illness will be excluded from participating in this trial. However, this trial will not screen for or exclude participants with history or laboratory evidence of prior SARS-CoV-2 infection, many of which might have been asymptomatic. Because pre-vaccination screening for prior infection is unlikely to occur in practice, it is important to understand vaccine safety and COVID-19 outcomes in in individuals with prior infection with SARS-CoV-2 virus.

5.3 Justification for Dose

Selection of the 12 µg mRNA dose level of CVnCOV for Trial CV-NCOV-004 was based on the safety, tolerability and immunogenicity results from Trials CV-NCOV-001 and CV NCOV-002.

5.4 End of Trial Definition

A subject is considered to have completed the trial when he/she has completed all visits, and procedures and tests applicable for the group to which he/she was randomized to.

End of Trial CV-NCOV-004 is defined as when the last subject has completed the last visit on Day 393 or prematurely discontinued the trial.

All subjects are expected to continue in the 1 year Extension Study in which the end of the trial is defined as when the last subject has completed the last visit on Day 757.

5.5 Stopping/Pausing Rules for Safety 5.5.1 Individual Subject Stopping Rules

The individual subject stopping rules are met in case any of the following events occur after the first trial vaccination:

An allergic/anaphylactic reaction considered as related to the trial vaccine

Any SAE considered as related to the trial vaccine

If any of these rules are met, the subject must not receive the second vaccine dose. The subject will be encouraged to continue participation until the end of the trial for safety.

5.5.2 Pausing of the Trial

The decision to pause the trial (i.e. temporary stopping of enrollment and vaccinations) due to a safety signal will be based on a recommendation from the DSMB in consultation with the Sponsor (see Section 9.3.9.1). The DSMB may recommend pausing the trial for a safety concern following a review of accumulating safety data presented at the regularly scheduled DSMB meetings or from an ongoing review of AEs, which include but are not limited to, suspected unexpected serious adverse reactions (SUSARs); all SAEs judged as related to trial vaccine; concerning SAEs (e.g., AESIs); and all life-threatening AEs and deaths. These events will be monitored by the DSMB on a regular basis during the trial. The selected AEs and procedures for the safety review are described in detail in the DSMB Charter.

To ensure subject safety on an ongoing basis, a blinded listing of the AEs as described above will be routinely monitored by the Chair of the DSMB (or designee) at regular intervals. For each review, the Chair {or designee(s)} will determine whether any single event or group of events constitute a new safety signal. If not, the Chair will inform the Study Team that there are no safety concerns. Conversely, if there is a safety concern, the Chair may unblind the AE or AEs and, if necessary, convene an ad-hoc DSMB meeting for further assessment of the event(s).

Based on the assessment of the benefit-risk ratio and biologic plausibility of a causal relationship of the AE(s) to the trial vaccine, the DSMB will make a recommendation to the Sponsor to either continue the trial as planned, modify its conduct, or pause the trial to allow further evaluation of the AE. If the latter, the Sponsor will make the decision to pause the study in consultation with the DSMB.

Please refer to the DSMB Charter for additional discussion of the DSMB's role and responsibilities.

6 Trial Population

The criteria for enrollment are to be followed explicitly. If it is noted that a subject who does not meet one or more of the inclusion criteria and/or meets one or more of the exclusion criteria is inadvertently enrolled and dosed, the Sponsor must be contacted immediately.

In this trial, individuals with a history of virologically-confirmed COVID-19 illness will be excluded from the trial. However, this trial will not screen for or exclude individuals with a history or laboratory evidence of prior SARS-CoV-2 infection. In addition, routine RT PCR testing will not be performed at screening to exclude individuals with SARS CoV 2 infection at the time of enrollment. Any country specific regulation(s) will be adhered to in addition.

6.1 Inclusion Criteria for all Subjects

Subjects will be enrolled in this trial only if they meet all of the following criteria:

1. Male or female subjects 18 years of age or older.
2. Provide written informed consent prior to initiation of any trial procedures.
3. Expected compliance with protocol procedures and availability for clinical follow-up through the last planned visit.
4. Females of non-childbearing potential defined as follows: surgically sterile (history of bilateral tubal ligation, bilateral oophorectomy or hysterectomy) or postmenopausal {defined as amenorrhea for ≥12 consecutive months prior to screening (Day 1) without an alternative medical cause}. A follicle-stimulating hormone (FSH) level may be measured at the discretion of the Investigator to confirm postmenopausal status.
5. Females of childbearing potential: negative urine pregnancy test {human chorionic gonatropin {hCG)} within 24 hours prior to each trial vaccination on Day 1 and Day 29.
6. Females of childbearing potential must use highly effective methods of birth control from 2 weeks before the first administration of the trial vaccine until 3 months following the last administration. The following methods of birth control are considered highly effective when used consistently and correctly:

Combined (estrogen and progestogen containing) hormonal contraception associated with inhibition of ovulation (oral, intravaginal or transdermal);

Progestogen-only hormonal contraception associated with inhibition of ovulation (oral, injectable or implantable);

Intrauterine devices (IUDs);

Intrauterine hormone-releasing systems (IUSs);

Bilateral tubal occlusion;

Vasectomized partner or infertile partner;

Sexual abstinence {periodic abstinence (e.g., calendar, ovulation, symptothermal and post-ovulation methods) and withdrawal are not acceptable}.

6.2 Exclusion Criteria

Subjects will not be enrolled in this trial if they meet any of the following criteria:

1. History of virologically-confirmed COVID-19 illness.
2. For females: pregnancy or lactation.
3. Use of any investigational or non-registered product (vaccine or drug) within 28 days preceding the administration of the first trial vaccine or planned use during the trial.
4. Receipt of licensed vaccines within 28 days (for live vaccines) or 14 days (for inactivated vaccines) prior to the administration of the first trial vaccine.
5. Prior administration of any investigational SARS-CoV-2 vaccine or another coronavirus (SARS-CoV, MERS-CoV) vaccine or planned use during the trial.
6. Any treatment with immunosuppressants or other immune-modifying drugs (including but not limited to corticosteroids, biologicals and methotrexate) for >14 days total within 6 months preceding the administration of trial vaccine or planned use during the trial. For corticosteroid use, this means prednisone or equivalent, 0.5 mg/kg/day for 14 days or more. The use of inhaled, topical, or localized injections of corticosteroids (e.g., for joint pain/inflammation) is permitted.
7. Any medically diagnosed or suspected immunosuppressive or immunodeficient condition based on medical history and physical examination including known infection with human immunodeficiency virus (HIV), hepatitis B virus (HBV) or hepatitis C virus (HCV); current diagnosis of or treatment for cancer including leukemia, lymphoma, Hodgkin disease, multiple myeloma, or generalized malignancy; chronic renal failure or nephrotic syndrome; and receipt of an organ or bone marrow transplant.
8. History of angioedema (hereditary or idiopathic), or history of any anaphylactic reaction or pIMD.
9. History of allergy to any component of CVnCoV vaccine.
10. Administration of immunoglobulins or any blood products within 3 months prior to the administration of trial vaccine or planned receipt during the trial.
11. Subjects with a significant acute or chronic medical or psychiatric illness that, in the opinion of the Investigator, precludes trial participation (e.g., may increase the risk of trial participation, render the subject unable to meet the requirements of the trial, or may interfere with the subject's trial evaluations). These include severe and/or uncontrolled cardiovascular disease, gastrointestinal disease, liver disease, renal disease, respiratory disease, endocrine disorder, and neurological and psychiatric illnesses. However, those with controlled and stable cases can be included in the trial.
12. Subjects with impaired coagulation or any bleeding disorder in whom an intramuscular injection or a blood draw is contraindicated.
13. Foreseeable non-compliance with the trial procedures as judged by the Investigator.

6.3 Vaccine Delay Recommendations

After enrollment, subjects may encounter clinical circumstances that could warrant a delay of trial vaccine administration as described below.

Subjects with a clinically significant (≥Grade 2) active infection or other acute disease (as assessed by the Investigator) or temperature≥38.0° C. (≥100.4° F.), within 3 days of intended trial vaccination on Day 1 or Day 29. This includes symptoms that could represent COVID-19 illness.

Trial vaccination should be delayed until the active infection or other acute disease has recovered to ≤Grade 1 or the subject's temperature has decreased to <38.0° C. (<100.4° F.). Following resolution of the illness, the subject may be rescheduled for trial vaccination based on the judgment of the Investigator.

Afebrile subjects with a minor illness may be vaccinated at the discretion of the Investigator.

Receipt of a licensed vaccine within 28 days (for live vaccines) or 14 days (for inactivated vaccines) prior to or after scheduled administration of trial vaccine. As these are recommended windows, rescheduling trial vaccination to be compliant with these windows should only be done if practical.

6.4 Failure to Meet Eligibility Criteria

The Investigator must account for all subjects who sign an informed consent. If the subject is found to be not eligible (i.e., did not meet all inclusion criteria or met one or more exclusion criteria), the Investigator should document this in the subject's source documents.

7 Trial Vaccine 7.1 Trial Vaccine Administration 7.1.1 Description of the Trial Vaccines CVnCoV is an investigational LNP-formulated RNActive® SARS-CoV-2 vaccine. The IMP is composed of the active pharmaceutical ingredient, an mRNA that encodes Wsmpv-SP, and 4 lipid components: cholesterol, 1,2 distearoyl-sn-glycero-3-phosphocholine (DSPC), PEG-ylated lipid and a cationic lipid. It is supplied as a concentrate at 1 mg/mL of mRNA drug substance.

The placebo vaccine will be sterile normal saline (0.9% NaCl) for injection.

7.1.2 Dosing and Administration 7.1.2.1 CVnCoV

Subjects randomized to CVnCoV will receive 2 injections of CVnCoV at a dose level of 12 µg mRNA, administered 28 days apart.

Administration of CVnCoV must be performed by intramuscular (IM) injection in the deltoid area, preferably in the non-dominant arm. CVnCoV is intended strictly for IM injection and must not be injected subcutaneously, intradermally, or intravenously. The instructions for injection as described in the Pharmacy Manual must be followed.

7.1.2.2 Placebo Control (Normal Saline)

Subjects randomized to the control arm of the trial will receive 2 doses of saline placebo {normal saline (0.9% NaCl) for injection}, administered 28 days apart.

Administration of saline placebo must be performed by IM injection in the deltoid area, preferably in the non-dominant arm. The instructions for injection described in the Pharmacy Manual must be followed.

7.1.2.3 Hypersensitivity Reactions to Vaccination

CVnCoV should not be administered to subjects with a known hypersensitivity to any of the components of the vaccine.

Since there is a theoretical risk of anaphylactic reactions, trial vaccine must only be administered if emergency equipment for the treatment of anaphylactic reactions (intravenous fluids, corticosteroids, H1 and H2 blocking agents, epinephrine, equipment for cardiopulmonary resuscitation) is readily available. All subjects must remain under direct supervision of personnel trained in the treatment of these reactions for at least 30 minutes following administration of trial vaccine.

If anaphylaxis or severe hypersensitivity reactions occur following trial vaccine administration, no further doses should be given (see Sections 5.5.1 and 8.1).

7.2 Preparation/Handling/Storage/Accountability

Refer to the Pharmacy Manual for detailed information on the preparation, handling, storage and blinding of CVnCoV and saline placebo.

7.2.1 CVnCoV Preparation

The concentrated CVnCoV must be diluted in the provided sterile normal saline (0.9% NaCl) diluent containing preservative to produce the dose solution for IM injection. This will be prepared by an unblinded qualified pharmacist according to the Handling Manual for the IMP provided by CureVac AG. The pharmacist will have no other trial function following vaccination and will maintain the treatment assignments in strict confidence.

7.2.2 CVnCoV Product Storage and Stability

Concentrated CVnCoV will be shipped to the site frozen at below −60° C.

Once at the site, concentrated CVnCoV should be stored frozen at below −60° C.

7.2.3 Placebo Control (Normal Saline)

The normal saline placebo control vaccine should be stored according to the Summary of Product Characteristics.

7.2.4 Accountability

It is the responsibility of the Investigator to ensure that the current and accurate records of trial supplies received, stored, and dispensed at the site are maintained using appropriate forms according to applicable regulations and guidelines. The trial supplies must be stored under the recommended storage conditions, locked with restricted access (refer to the Pharmacy Manual). Authorized personnel must dispense the vaccine at the trial site and in accordance with the protocol and applicable regulations and guidelines.

IMP accountability and inventory logs must be kept up-to-date at the trial site with the following information:

Dates and quantities of CVnCoV received from CureVac.
Unique subject identifier.
Date and quantity of trial vaccine dispensed to each subject.
Initials of the person preparing the dose.
Initials of the person administering the vaccine.

These logs must be readily available for inspections and are open to regulatory inspection at any time.

7.3 Randomization and Blinding

Both Phase 2b and Phase 3 will be randomized, observer-blinded, and placebo-controlled. The difference in appearance of the investigational CVnCoV vaccine and placebo required the trial to be conducted in an observer-blinded manner, which is a well-accepted method for blinding.

7.3.1 Randomization

Subjects 18 years of age or older will be enrolled at multiple sites globally and will be randomized in a 1:1 ratio to receive either CVnCoV or placebo. The randomization will be performed centrally and stratified by country and age group (18 to 60 and 61 years of age). The randomization scheme will be generated and maintained by an Independent Statistical group at the contract research organization (CRO), PRA. Subjects will be enrolled into the trial online and randomized using an interactive web response system (IWRS). After demographic and eligibility criteria are entered into the system, each subject enrolled into the trial will be assigned their treatment assignment.

7.3.2 Blinding

Subjects will be randomized and vaccinated with CVnCoV or placebo in an observer blinded manner (due to the difference in appearance and presentation of the investigational CVnCoV vaccine and placebo). The pharmacist at the site will not be blinded to the identity of the trial vaccine being administered to the subject. However, the vaccinator, Investigator and all site personnel involved in the conduct of the trial (including follow-up of safety and COVID-19 case ascertainment) will be blinded to trial vaccine and subject treatment assignments. To maintain the blinding of the vaccinator, the pharmacist will provide the dose of trial vaccine to the vaccinator prefilled in a syringe with a label covering the liquid contents so that it is not visible. All personnel at the CRO and Sponsor directly involved in the conduct of the trial will also be blinded. There will be certain individuals at the CRO and Sponsor whose function requires them to be unblinded during the trial {e.g., unblinded monitoring for trial vaccine accountability in the pharmacy; unblinded independent statistician assisting the DSMB; review of immunogenicity data (see next paragraph)}. These unblinded individuals will be identified and their responsibilities documented. Because the immunogenicity results would unblind the subject's treatment assignment, the independent laboratory performing the assays will keep the results in strict confidence. An unblinded person, named at the start of the trial and independent of the conduct of the trial, will have the responsibility of reviewing the quality of the immunogenicity data as it is being generated. This person will maintain the results in strict confidence. To maintain the blind, the immunogenicity data will only be merged with the clinical database following unblinding of the trial.

It will be at the discretion of the DSMB members whether or not safety data reviewed at the DSMB meetings will be unblinded. If there are any safety concerns, the DSMB may request unblinding of an individual subject or a specific dataset at any time. In addition, the DSMB will periodically monitor COVID-19 cases by vaccine group for signals of VDE. At the interim analyses, the DSMB will review cases of COVID-19 cases by vaccine group for efficacy or futility, and will communicate the outcome to the Sponsor in a blinded manner.

For the submission of documents for regulatory approval during the ongoing conduct of Trial CV-NCOV-004 (e.g., if efficacy is demonstrated at one of the interim analyses), an unblinded Submission Team will be formed which will be completely independent of the team conducting the trial. The Submission Team will comprise individuals from the Sponsor and CRO, and their roles and responsibilities on the unblinded team will be clearly defined.

7.3.3 Emergency Unblinding

Individual unblinding should only occur in emergency situations for reasons of subject safety when knowledge of the trial vaccine is essential for the clinical management or welfare of the subject. Unblinding in this situation will be based on the judgment of the Investigator, ideally in discussion with the Sponsor.

In general, the identity of the trial vaccine should not affect the clinical management of any SAE/AE. Whenever possible, the Investigator should attempt to contact the Sponsor before breaking the blind to discuss the need for emergency unblinding. Once agreed, code-breaking will be carried out via the IWRS.

When the blind is broken, the date, exact timing, and reason must be fully documented in the source documents. The Investigator should not inform other blinded trial staff of the identity of the IMP.

If the code has been broken and there are no medical reasons for discontinuation, the subject may continue in the trial. If the subject has received at least 1 dose of trial vaccine, it will be the judgment of the Investigator, in consultation with the Sponsor, whether the subject will be vaccinated with the second dose. If the subject is discontinued from the trial, every effort should be made to continue safety follow-up of the subject until the end of the trial.

7.4 Vaccine Compliance

The Investigator must record all trial vaccinations administered in the subject's eCRF page.

7.5 Misuse and Overdose

Definition of misuse: Situations where the trial vaccine is intentionally and inappropriately used not in accordance with the protocol dosing instructions or authorized product information.

Definition of overdose: Administration of a quantity of the trial vaccine given per administration or cumulatively which is above the maximum recommended dose according to the protocol dosing instructions or authorized product information.

No toxic effects are expected from current clinical and non-clinical experience. Possible local reactions (pain) or systemic AEs (fever, headache, fatigue, chills, myalgia, arthralgia, nausea/vomiting and diarrhea) may be treated symptomatically with physical measures, paracetamol, or non-steroidal anti-inflammatory drugs.

7.6 Concomitant Therapy and Vaccines

Concomitant medication and vaccines including the reason for administration must be recorded in the subject's eCRF.

7.6.1 Permitted Medications/Vaccines During the Trial

Subjects are permitted to use antipyretics and other pain medications to treat any ongoing condition(s) the subject may have. Antipyretics (e.g., paracetamol) or other pain medication may be used to treat any local and/or systemic reactions associated with trial vaccination. Paracetamol taken prophylactically for potential vaccine-associated reactions is also permitted in this trial. For example, if a subject experiences adverse reactions following the first trial vaccination, paracetamol may be taken prophylactically for these reactions for the second trial vaccination. In this case, paracetamol (up to 1 gram dose) may be taken after trial vaccination and at bedtime, and then in the morning and at bedtime during the next day. Alternatively, a 500 mg dose of paracetamol may be taken every 6 hours after trial vaccination for up to 36 hours. The dose and dosing schedule of paracetamol should be discussed with the Investigator.

Paracetamol administered as a treatment for vaccine-associated reactions or for prophylaxis, along with timing of administration with respect to trial vaccination must be documented in the eCRF.

Other than the prohibited medications and vaccines described in Section 6.2 and listed below in Section 7.6.2, medications that are required for the treatment of the subject's pre existing medical conditions are permitted.

7.6.2 Prohibited Medications/Vaccines During the Trial

Use of any investigational or non-registered product (vaccine or drug) is prohibited during the trial.

Licensed vaccines should not be administered within 28 days (for live vaccines) or 14 days (for inactivated vaccines) of trial vaccine administration during the trial.

Receipt of any other investigational SARS-CoV-2 vaccine or other coronavirus vaccine is prohibited during the trial.

Any treatment with immunosuppressants or other immune-modifying drugs (including but not limited to corticosteroids, biologicals and methotrexate) is prohibited during the trial. For corticosteroid use, this means prednisone or equivalent, 0.5 mg/kg/day for 14 days or more. The use of inhaled, topical, or localized injections of corticosteroids (e.g., for joint pain/inflammation) is permitted.

Administration of immunoglobulins or any blood products is prohibited during the trial.

7.7 Therapy Leading to Discontinuation

If a subject requires therapy listed as an exclusion criterion in Section 6.2 and which cannot be delayed, discontinuation would be considered to ensure integrity of the trial data, following individual case review. Every effort should be made to continue safety follow-up of the subject until the end of the trial.

7.8 Treatment after the End of Trial

No post-trial care will be provided.

8 Discontinuation/Withdrawal Criteria

Participation in the trial is strictly voluntary. A subject has the right to withdraw from the trial at any time and for any reason. The Investigator has the right to withdraw a subject from further trial vaccine administration and/or the trial if this is considered in the subject's best interest or as a result of a protocol deviation.

For discontinuations due to an AE, every effort should be made to document the outcome of the event.

Subjects who received at least 1 dose of trial vaccine will be encouraged to continue participation until the end of the trial for safety assessments.

8.1 Discontinuation of Trial Vaccine Administration

The primary reason for discontinuation of further administration of trial vaccine will be recorded in the subject's eCRF according to the following categories:

Consent withdrawal by the subject.

The reason for withdrawal, if provided, should be recorded in the eCRF.

Note: All attempts should be made to determine the underlying reason for the withdrawal and, where possible, the primary underlying reason should be recorded (i.e., withdrawal due to an AE should not be recorded in the "voluntary withdrawal" category).

AE (including known side effects of the trial vaccine).

If discontinuation is due to an AE possibly related to the trial vaccine or trial procedures, the subject must be followed-up by additional examinations according to the medical judgment of the Investigator until the condition is resolved or the Investigator deems further observations or examinations to be no longer medically indicated.

Change in the subject's overall medical status prohibiting further participation.

Pregnancy (see Section 9.3.5).

Any subject who, despite the requirement for adequate contraception, becomes pregnant during the trial will not receive further trial vaccine doses. The site should maintain contact with the pregnant subject and complete a "Clinical Trial Pregnancy Form" as soon as possible. In addition, the subject should be followed-up until the birth of the child, or spontaneous or voluntary termination. When pregnancy outcome information becomes available, the information should be captured using the same form. The subject should be reported as an IMP discontinuation and the reason (i.e. pregnancy) should be given.

Trial terminated by the Sponsor (in which case the minimum safety follow-up conducted at the end of trial visit on Day 393 would be performed).

Major protocol deviation.

Other.

Note: The specific reasons should be recorded in the "specify" field of the eCRF.

8.2 Withdrawal from the Trial

Subjects should be withdrawn from the trial in case any of the following situations occur:

Continued participation jeopardizes the subject's health, safety, or rights.

The subject has experienced an AE that requires early termination because continued participation imposes an unacceptable risk to the subject's health or the subject is unwilling to continue because of the AE. The reasons for not performing further safety or immunogenicity assessments should be documented.

The subject did not return to the site and multiple attempts (a minimum of 3 attempts) to contact the subject were unsuccessful (lost to follow-up).

The subject wishes to withdraw from the trial. The reason for withdrawal, if provided, should be recorded.

All attempts should be made to determine the underlying reason for the withdrawal and, where possible, the primary underlying reason should be recorded (i.e., withdrawal due to an AE should not be recorded in the "voluntary withdrawal" category).

Any subject who prematurely terminates participation and who has received at least one trial vaccine dose will undergo the same procedures as for the end of trial visit, unless such procedures are considered to pose unacceptable risk to the subject.

Discontinued or withdrawn subjects will not be replaced.

8.3 Trial Termination

The Sponsor reserves the right to terminate the trial at any time. Possible reasons for trial termination include the following:

Outcome of the interim analysis may show high VE or futility.

Safety reasons: the incidence of AEs in this or any other trial using a related vaccine indicates a potential health risk for the subjects.

New scientific knowledge becomes known that makes the objectives of the trial no longer feasible/valid.

The site is unlikely to be able to recruit sufficient subjects within the agreed time frame.

The site does not respond to trial management requests.

Repeated protocol deviations.

Unsafe or unethical practices.

Administrative decision.

Following a trial termination decision, the Investigator must contact all subjects within a time period set by the Sponsor. All trial materials must be collected and relevant documentation completed to the greatest extent possible. The trial can also be terminated by the Regulatory Authority for any reason or if recommended by the DSMB, or at a site level by the Independent Ethics Committee or Institutional Review Board (IEC/IRB). The Sponsor may close an individual site prematurely for reasons such as poor protocol compliance or unsatisfactory recruitment of subjects.

8.4 Lost to Follow-Up

All efforts should be made to contact subjects who have not returned for the scheduled trial visit or who are unable to be contacted for a scheduled phone call. A minimum of 3 attempts should be made and documented. If a subject is lost to follow-up before resolution of related SAEs or AEs, the Sponsor may consider further attempts to contact the subject in order to collect follow-up safety information.

9 Trial Assessments and Procedures

The trial assessments and procedures are discussed in this section.

For subjects who are unable to come to the site for protocol-specified site visits (e.g., due to the public health emergency related to COVID-19), safety assessments may be performed using alternative methods (e.g., phone contact, virtual visit, alternative location for assessment).

For further flexibility in trial conduct in the pandemic setting, home visits will be allowed to perform safety assessments and procedures including the collection of blood and any bio samples. If site visits, phone contacts or sample collection cannot be performed within the protocol defined windows, in such unique circumstances as a public health emergency, it will be acceptable to perform these tasks outside of these windows. In the pandemic setting, the protocol-defined windows for site visits and phone contacts are provided for guidance and will not be considered deviations, if not strictly adhered to.

An electronic diary (eDiary) will be used during the trial for efficient collection of safety related information. However, paper diaries may be substituted for some subjects during the trial.

Initiation of subject enrollment of the 2 target age groups into Phase 2b will be flexible. Depending on the timing of data from the Phase 1 and Phase 2a trials, enrollment of the 2 age groups into Phase 2b may be staggered, initially starting with subjects 18 to 60 years of age followed by subjects≥61 years of age. As the older age group will comprise 20% to 25% of the total number of subjects in Phase 2b, this staggered start is not expected to impact overall enrollment of the Phase 2b cohort.

9.1 Schedule of Trial Assessments and Procedures

By signing the informed consent form, subjects will be consenting to participate in both Trial CV-NCOV-004 and its 1 year Extension Study for a total of approximately 2.1 years of participation.

The trial assessments and procedures apply to all subjects, independent if they had known SARS CoV-2 positive serology before the trial or independent of the serology status at baseline as per retrospective analysis.

Subjects participating in Phase 2b will be given a thermometer to measure body temperature orally and a measuring tape to determine the size of local injection site reactions. Subjects will be instructed on how to enter the solicited AEs daily for 7 days in the eDiary.

During the conduct of the trial and interactions with subjects, any person with early warning signs of COVID-19 should be referred to emergency medical care immediately. These signs include, but are not limited to, the following: difficulty breathing, persistent pain or pressure in the chest, new confusion, inability to awake or stay awake, or bluish lips or face.

9.1.1 Phase 2b: Immunogenicity Subset

The Immunogenicity Subset of Phase 2b will include the first 600 subjects enrolled into each of the 2 age groups, 18-60 and ≥61 years of age, into Phase 2b. As such, the target total enrollment will be approximately 1,200 subjects.

9.1.1.1 Clinic Visit 1: Day 1—First Trial Vaccination

Note that procedures to establish subject eligibility, recording of demographic information and medical history may be performed within 21 days prior to trial vaccine administration, i.e., spread out over more than 1 day. However, if all information is available and assessments and procedures can be performed, eligibility can be established on the same day of trial vaccine administration. All eligibility criteria must be reviewed prior to trial vaccine administration on Day 1.

Pre-Vaccination Procedures

Obtain signed informed consent form.
Signed informed consent must be obtained prior to the subject entering into the trial, and before any protocol-directed procedures are performed.
By signing the informed consent form, the subject voluntarily agrees to participate in the HERALD Trial CV-NCOV-004 and its 1 year Extension Study for a total of approximately 2 years.
Review inclusion/exclusion criteria (see Section 6.1 and 6.2) and review prohibited medications listed as an exclusion criterion (see Section 6.2).
Record demographic information.
Record medical history.
Record concomitant medications and vaccinations, including recurring medications for intermittent conditions, if taken within 6 months prior to enrollment in this trial.
Perform a complete physical examination, including height and weight (see Section 9.3.7). If the complete physical examination to establish eligibility was performed within 21 days prior to trial vaccine administration, a symptom-directed physical examination should be performed on the day of vaccination prior to trial vaccine administration.
Measure vital signs (body temperature, pulse, blood pressure; see Section 9.3.7).
Perform urine pregnancy test in females of childbearing potential.
Collect pre-vaccination blood samples for binding antibody testing to RBD of S protein of SARS-CoV-2 (~6 mL blood); SARS-CoV-2 viral neutralizing activity (~6 mL blood); and binding antibody testing to N protein of SARS CoV 2 (~6 mL blood).
Collect pre-vaccination blood samples for genomic biomarkers (~6 mL blood) from subjects at selected site(s).
Collect pre-vaccination blood samples for CMI (~32 mL blood) from subjects at selected site(s).

Vaccination Procedure

Review criteria for delay or cancellation of vaccination. See Sections 6.3 and 8.1 for an overview of the criteria leading to delay or cancellation of vaccine administration. In case of delay, the vaccination should take place within the allowed time windows. The reasons for delay or cancellation should be documented in the subject's chart.
Administer the trial vaccine dose according to the subject's assignment.

Post-Vaccination Procedures

Observe the subject on site for at least 30 minutes following vaccination for safety monitoring. At the end of the observation period:
Measure vital signs (body temperature, pulse, blood pressure; see Section 9.3.7).
The subject may not be discharged until vital signs are within normal range or have returned to pre-vaccination levels.
Record the occurrence of any AEs following trial vaccination.
Instructions for the subject:
Instruct the subject how to measure solicited AEs and how to complete the eDiary. The subject should record solicited local and systemic AEs occurring on the day of vaccination and the following 7 days, and unsolicited AEs (i.e., the occurrence of all other AEs) occurring on the day of vaccination and the following 28 days.
Remind the subject to call the site immediately to report the following:
If he/she experiences any concerning local or systemic reactions or other medical event.
Any medically-attended visits that are not routine visits for physical examination or vaccination, such as visits for hospitalization, an emergency room visit, or an otherwise unscheduled visit to or from medical personnel (medical doctor) for any reason.
Experience a serious medical event, have a change in overall health or be diagnosed with a new medical condition by a doctor. These should be reported regardless of the perceived relationship between the event and the trial vaccine.
Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).
The subject should also be reminded to contact the site immediately if he/she had a positive SARS-CoV-2 test performed outside of the site, whether they were symptomatic (COVID-19 illness) or asymptomatic at the time of the test.
Note: Subjects without symptoms may have been tested for several reasons, for example, close exposure to a known person with SARS-CoV-2 infection or as part of their routine screening as a healthcare provider.

9.1.1.2 Phone Call: Day 2 (−0/+0 Day)

The purpose of this phone contact is to inquire about the subject's general well-being and to assess safety 1 day after the first trial vaccination.

During the phone call:

- Review and record any newly reported safety data including solicited and unsolicited AEs, or other AEs (medically-attended AEs, SAEs).
- Record concomitant medications and vaccinations, including recurring medications for intermittent conditions.
- If the subject reports any concerning local or systemic reactions, or other AEs (e.g., medically-attended AEs, SAEs), these should be followed-up either by a phone call(s) or by an unscheduled site visit based on the judgment of the Investigator.

Instructions for the subject:

- Remind the subject to continue recording solicited and unsolicited AEs (i.e., the occurrence of all other AEs) in the eDiary.
- Remind the subject to call the site immediately to report the following:
- If he/she experiences any concerning local or systemic reactions or other medical event.
- Any medically-attended visits that are not routine visits for physical examination or vaccination, such as visits for hospitalization, an emergency room visit, or an otherwise unscheduled visit to or from medical personnel (medical doctor) for any reason.
- Experience a serious medical event, have a change in overall health or be diagnosed with a new medical condition by a doctor. These should be reported regardless of the perceived relationship between the event and the trial vaccine.
- Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).
- The subject should also be reminded to contact the site immediately if he/she had a positive SARS-CoV-2 test performed outside of the site, whether they were symptomatic (COVID-19 illness) or asymptomatic at the time of the test.

9.1.1.3 Clinic Visit 2: Day 29—Second Trial Vaccination (−3/+7 Days)

Pre-Vaccination Procedures

- Review and record any newly reported safety data including solicited and unsolicited AEs, or other AEs (medically-attended AEs, SAEs).
- Record concomitant medications and vaccinations, including recurring medications for intermittent conditions.
- Perform a symptom-directed physical examination (see Section 9.3.7).
- Measure vital signs (body temperature, pulse, blood pressure, see Section 9.3.7).
- Perform urine pregnancy test in females of childbearing potential.
- Collect pre-vaccination blood samples for binding antibody testing to RBD of S protein of SARS-CoV-2 (~6 mL blood) and SARS-CoV-2 viral neutralizing activity (~6 mL blood). No testing of antibody to N protein of SARS-CoV-2 will performed at this time point.
- Collect pre-vaccination blood samples for genomic biomarkers (~6 mL blood) from subjects at selected site(s).
- Collect pre-vaccination blood samples for CMI (~32 mL blood) from subjects at selected site(s).

Vaccination Procedure

- Review criteria for delay or cancellation of vaccination. See Sections 6.3 and 8.1 for an overview of the criteria leading to delay or cancellation of vaccine administration. In case of delay, the vaccination should take place within the allowed time windows. The reasons for delay or cancellation should be documented in the subject's chart.
- Administer the trial vaccine dose according to the subject's assignment.

Post-Vaccination Procedures

- Observe the subject on site for at least 30 minutes following vaccination for safety monitoring. At the end of the observation period:
- Measure vital signs (body temperature, pulse, blood pressure; see Section 9.3.7).
- The subject may not be discharged until vital signs are within normal range or have returned to pre-vaccination levels.
- Record the occurrence of any AEs following trial vaccination.

Instructions for the subject:

- Re-instruct the subject how to measure solicited AEs and how to complete the eDiary. The subject should record solicited local and systemic AEs occurring on the day of vaccination and the following 7 days, and unsolicited AEs (i.e., the occurrence of all other AEs) occurring on the day of vaccination and the following 28 days.
- Remind the subject to call the site immediately to report the following:
- If he/she experiences any concerning local or systemic reactions or other medical event.
- Any medically-attended visits that are not routine visits for physical examination or vaccination, such as visits for hospitalization, an emergency room visit, or an otherwise unscheduled visit to or from medical personnel (medical doctor) for any reason.
- Experience a serious medical event, have a change in overall health or be diagnosed with a new medical condition by a doctor. These should be reported regardless of the perceived relationship between the event and the trial vaccine.
- Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).
- The subject should also be reminded to contact the site immediately if he/she had a positive SARS-CoV-2 test performed outside of the site, whether they were symptomatic (COVID-19 illness) or asymptomatic at the time of the test.

9.1.1.4 Phone Call: Day 30 (−0/+0 Day)

The purpose of this phone contact is to inquire about the subject's general well-being and to assess safety 1 day after the second trial vaccination.

The assessments and procedures are identical to those performed during the phone call on Day 2.

9.1.1.5 Clinic Visit 3: Day 43 (−3/+3 Days)

Review and record any newly reported safety data including solicited and unsolicited AEs, or other AEs (medically-attended AEs, SAEs).

Record concomitant medications and vaccinations, including recurring medications for intermittent conditions.

Perform a symptom-directed physical examination (see Section 9.3.7).

Measure vital signs (body temperature, pulse, blood pressure, see Section 9.3.7).

Collect blood samples for binding antibody testing to RBD of S protein of SARS CoV-2 (~6 mL blood); SARS-CoV-2 viral neutralizing activity (~6 mL blood); and binding antibody testing to N protein of SARS-CoV-2 (~6 mL blood).

Collect blood samples for genomic biomarkers (~6 mL blood) from subjects at selected site(s).

Collect blood samples for CMI (~32 mL blood) from subjects at selected site(s).

Instructions for the subject:

Inform the subject that recording of solicited local and systemic reactions in the eDiary is complete. Remind the subject to continue recording unsolicited AEs (all AEs).

Remind the subject to call the site immediately to report the following:

If he/she experiences any concerning medical event.

Any medically-attended visits that are not routine visits for physical examination or vaccination, such as visits for hospitalization, an emergency room visit, or an otherwise unscheduled visit to or from medical personnel (medical doctor) for any reason.

Experience a serious medical event, have a change in overall health or be diagnosed with a new medical condition by a doctor. These should be reported, regardless of the perceived relationship between the event and the trial vaccine.

Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).

The subject should also be reminded to contact the site immediately if he/she had a positive SARS-CoV-2 test performed outside of the site, whether they were symptomatic (COVID-19 illness) or asymptomatic at the time of the test.

9.1.1.6 Clinic Visit 4: Day 57 (−3/+7 Days)

Review and record any newly reported safety data including unsolicited AEs or other AEs (medically-attended AEs, SAEs).

Record concomitant medications and vaccinations, including recurring medications for intermittent conditions.

Perform a symptom-directed physical examination (see Section 9.3.7).

Measure vital signs (body temperature, pulse, blood pressure, see Section 9.3.7).

Collect a blood sample for immunogenicity assessment for binding antibody testing to RBD of S protein of SARS-CoV-2 (~6 mL blood) and SARS-CoV-2 viral neutralizing activity (~6 mL blood). (No testing of binding antibody to N protein of SARS CoV 2 will performed at this time point).

Instructions for the subject:

Inform the subject that reporting of unsolicited AEs is complete.

Remind the subject to call the site immediately to report the following:

If he/she experiences any concerning medical event.

Any medically-attended visits that are not routine visits for physical examination or vaccination, such as visits for hospitalization, an emergency room visit, or an otherwise unscheduled visit to or from medical personnel (medical doctor) for any reason.

Experience a serious medical event, have a change in overall health or be diagnosed with a new medical condition by a doctor. These should be reported regardless of the perceived relationship between the event and the trial vaccine.

Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).

The subject should also be reminded to contact the site immediately if he/she had a positive SARS-CoV-2 test performed outside of the site, whether they were symptomatic (COVID-19 illness) or asymptomatic at the time of the test.

9.1.1.7 Clinic Visit 5: Day 120 (−7/+7 Days)

Review and record any newly reported AEs since the site visit on Day 57 (medically-attended AEs, SAEs).

Record concomitant medications and vaccinations, including recurring medications for intermittent conditions.

Perform a symptom-directed physical examination (see Section 9.3.7).

Measure vital signs (body temperature, pulse, blood pressure, see Section 9.3.7).

Collect blood samples for binding antibody testing to RBD of S protein of SARS CoV-2 (~6 mL blood) and SARS-CoV-2 viral neutralizing activity (~6 mL blood). (No testing of binding antibody to N protein of SARS CoV 2 will performed at this time point).

Collect blood samples for genomic biomarkers (~6 mL blood) from subjects at selected site(s).

Collect blood samples for CMI (~32 mL blood) from subjects at selected site(s).

Instructions for the subject:

Remind the subject to call the site immediately to report the following:

If he/she experiences any concerning medical event.

Any medically-attended visits that are not routine visits for physical examination or vaccination, such as visits for hospitalization, an emergency room visit, or an otherwise unscheduled visit to or from medical personnel (medical doctor) for any reason.

Experience a serious medical event, have a change in overall health or be diagnosed with a new medical condition by a doctor. These should be reported regardless of the perceived relationship between the event and the trial vaccine.

Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).

The subject should also be reminded to contact the site immediately if he/she had a positive SARS-CoV-2 test performed outside of the site, whether they were symptomatic (COVID-19 illness) or asymptomatic at the time of the test.

9.1.1.8 Clinic Visit 6: Day 211 (−7/+7 Days)

The assessments and procedures are identical to those performed during Clinic Visit 5 on Day 120, except for the below.

Collect blood samples for binding antibody testing to RBD of S protein of SARS CoV-2 (~6 mL blood); SARS-CoV-2 viral neutralizing activity (~6 mL blood); and binding antibody testing to N (nucleocapsid) protein of SARS-CoV-2 (~6 mL blood).

Collect blood samples for genomic biomarkers (~6 mL blood) from subjects at selected site(s).

9.1.1.9 Phone Call: Day 302 (−7/+7 Days)

The purpose of this phone contact is to inquire about the subject's general well-being and to assess safety since the site visit on Day 211.

During the phone call:

Review and record any newly reported AEs since the site visit on Day 211 (SAEs).

Record concomitant medications and vaccinations, including recurring medications for intermittent conditions.

If the subject reports by phone any concerning AEs, these should be followed-up either by a phone call(s) or by an unscheduled site visit based on the judgment of the investigator.

Instructions for the subject:

Remind the subject to call the site immediately to report the following:

If he/she experiences any concerning medical event.

Any medically-attended visits that are not routine visits for physical examination or vaccination, such as visits for hospitalization, an emergency room visit, or an otherwise unscheduled visit to or from medical personnel (medical doctor) for any reason.

Experience a serious medical event, have a change in overall health or be diagnosed with a new medical condition by a doctor. These should be reported regardless of the perceived relationship between the event and the trial vaccine.

Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).

The subject should also be reminded to contact the site immediately if he/she had a positive SARS-CoV-2 test performed outside of the site, whether they were symptomatic (COVID-19 illness) or asymptomatic at the time of the test.

9.1.1.10 End of Trial Visit: Day 393 (−0/+21 Days)

The end of trial visit will be performed on Day 393, 1 year after the last trial vaccine administration. If possible, this visit should include subjects who prematurely discontinued vaccination during the trial. The following assessments should be performed:

Review and record any newly reported AEs since the phone contact on Day 302 (SAEs).

Record concomitant medications and vaccinations, including recurring medications for intermittent conditions.

Perform a complete physical examination, including height and weight (see Section 9.3.7).

Measure vital signs (body temperature, pulse, blood pressure, see Section 9.3.7).

Collect blood samples for binding antibody testing to RBD of S protein of SARS CoV-2 (~6 mL blood); SARS-CoV-2 viral neutralizing activity (~6 mL blood); and binding antibody testing to N protein of SARS-CoV-2 (~6 mL blood).

Inform the subject that they have completed the main part of the trial and that the extension part of the trial will now begin (see Section 9.1.4).

9.1.2 Phase 2b: Non-Immunogenicity Subjects

Following enrollment of subjects into the Immunogenicity Subset of Phase 2b (n=1,200), the remaining 2,800 subjects, 18 years of age and older, will be enrolled into Phase 2b.

9.1.2.1 Clinic Visit 1: Day 1—First Trial Vaccination

Note that procedures to establish subject eligibility, recording of demographic information and medical history may be performed within 21 days prior to trial vaccine administration, i.e., spread out over more than 1 day. However, if all information is available and assessments and procedures can be performed, eligibility can be established on the same day of trial vaccine administration. All eligibility criteria must be reviewed prior to trial vaccine administration on Day 1.

Pre-Vaccination Procedures

Obtain the signed informed consent form.

Signed informed consent must be obtained prior to the subject entering into the trial, and before any protocol-directed procedures are performed (see Section 12.4).

By signing the informed consent form, the subject voluntarily agrees to participate in the HERALD Trial CV-NCOV-004 and its 1 year Extension Study for a total of approximately 2 years.

Review inclusion/exclusion criteria (see Section 6.1 and 6.2) and review prohibited medications listed as an exclusion criterion (see Section 6.2).

Record demographic information.

Record medical history.

Record concomitant medication and vaccination, including recurring medication for intermittent conditions, if taken within 6 months prior to enrollment in this trial.

Perform a complete physical examination, including height and weight (see Section 9.3.7). If the complete physical examination to establish eligibility was performed within 21 days prior to trial vaccine administration, a symptom-directed physical examination should be performed on the day of vaccination prior to trial vaccine administration.

Measure vital signs (body temperature, pulse, blood pressure, see Section 9.3.7).

Perform urine pregnancy test in females of childbearing potential.

Collect pre-vaccination blood sample) for binding antibody testing to N protein of SARS-CoV-2 (~6 mL blood).

Vaccination Procedure

Review criteria for delay or cancellation of vaccination. See Sections 6.3 and 8.1 for an overview of the criteria leading to delay or cancellation of vaccine administration. In case of delay, the vaccination should take place within the allowed time windows. The reasons for delay or cancellation should be documented in the subject chart.

Administer the trial vaccine dose according to the subject's assignment.

Post-Vaccination Procedures

Observe the subject on site for at least 30 minutes following vaccination for safety monitoring. At the end of the observation period:

Measure vital signs (body temperature, pulse, blood pressure, see Section 9.3.7).

The subject may not be discharged until vital signs are within normal range or have returned to pre-vaccination levels.

Record the occurrence of any AEs following trial vaccination.

Instructions for the subject:

Instruct the subject how to measure solicited AEs and how to complete the eDiary. The subject should record solicited local and systemic AEs occurring on the day of vaccination and the following 7 days, and unsolicited AEs (i.e., the occurrence of all other AEs) occurring on the day of vaccination and the following 28 days.

Remind the subject to call the site immediately to report the following:

If he/she experiences any concerning local or systemic reactions or other medical event.

Any medically-attended visits that are not routine visits for physical examination or vaccination, such as visits for hospitalization, an emergency room visit, or an otherwise unscheduled visit to or from medical personnel (medical doctor) for any reason.

Experience a serious medical event, have a change in overall health or be diagnosed with a new medical condition by a doctor. These should be reported regardless of the perceived relationship between the event and the trial vaccine.

Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).

The subject should also be reminded to contact the site immediately if he/she had a positive SARS-CoV-2 test performed outside of the site, whether they were symptomatic (COVID-19 illness) or asymptomatic at the time of the test.

Note: Subjects without symptoms may have been tested for several reasons, for example, close exposure to a known person with SARS-CoV-2 infection or as part of their routine screening as a healthcare provider.

9.1.2.2 Phone Call: Day 2 (−0/+0 Day)

The purpose of this phone contact is to inquire about the subject's general well-being and to assess safety 1 day after the first trial vaccination.

During the phone call:

Review and record any newly reported safety data including solicited and unsolicited AEs, or other AEs (medically-attended AEs, SAEs).

Record concomitant medications and vaccinations, including recurring medications for intermittent conditions.

If the subject reports any concerning local or systemic reactions, or other AEs (e.g., medically-attended AEs, SAEs), these should be followed-up either by a phone call(s) or by an unscheduled site visit based on the judgment of the investigator.

Instructions for the subject:

Remind the subject to continue recording solicited and unsolicited AEs (i.e., the occurrence of all other AEs) in the eDiary.

Remind the subject to call the site immediately to report the following:

If he/she experiences any concerning local or systemic reactions or other medical event.

Any medically-attended visits that are not routine visits for physical examination or vaccination, such as visits for hospitalization, an emergency room visit, or an otherwise unscheduled visit to or from medical personnel (medical doctor) for any reason.

Experience a serious medical event, have a change in overall health or be diagnosed with a new medical condition by a doctor. These should be reported regardless of the perceived relationship between the event and the trial vaccine.

Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).

The subject should also be reminded to contact the site immediately if he/she had a positive SARS-CoV-2 test performed outside of the site, whether they were symptomatic (COVID-19 illness) or asymptomatic at the time of the test.

9.1.2.3 Clinic Visit 2: Day 29—Second Trial Vaccination (−3/+7 Days)

Pre-Vaccination Procedures

Review and record any newly reported safety data including solicited and unsolicited AEs, or other AEs (medically-attended AEs, SAEs).

Record concomitant medications and vaccinations, including recurring medications for intermittent conditions.

Perform a symptom-directed physical examination (see Section 9.3.7).

Measure vital signs (body temperature, pulse, blood pressure, see Section 9.3.7).

Perform urine pregnancy test in females of childbearing potential.

Vaccination Procedure

Review criteria for delay or cancellation of vaccination. See Sections 6.3 and 8.1 for an overview of the criteria leading to delay or cancellation of vaccine administration. In case of delay, the vaccination should take place within the allowed time windows. The reasons for delay or cancellation should be documented in the subject chart.

Administer the trial vaccine dose according to the subject's assignment.

Post-Vaccination Procedures

Observe the subject on site for at least 30 minutes following vaccination for safety monitoring. At the end of the observation period:

Measure vital signs (body temperature, pulse, blood pressure, see Section 9.3.7).

The subject may not be discharged until vital signs are within normal range or have returned to pre-vaccination levels.

Record the occurrence of any AEs following trial vaccination.

Instructions for the subject:

Re-instruct the subject how to measure solicited AEs and how to complete the eDiary. The subject should record solicited local and systemic AEs occurring on the day of vaccination and the following 7 days, and unsolicited AEs (i.e. the occurrence of all other AEs) occurring on the day of vaccination and the following 28 days.

Remind the subject to call the site immediately to report the following:

If he/she experiences any concerning local or systemic reactions or other medical event.

Any medically-attended visits that are not routine visits for physical examination or vaccination, such as visits for hospitalization, an emergency room visit, or an otherwise unscheduled visit to or from medical personnel (medical doctor) for any reason.

Experience a serious medical event, have a change in overall health or be diagnosed with a new medical condition by a doctor. These should be reported regardless of the perceived relationship between the event and the trial vaccine.

Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).

The subject should also be reminded to contact the site immediately if he/she had a positive SARS-CoV-2 test performed outside of the site, whether they were symptomatic (COVID-19 illness) or asymptomatic at the time of the test.

9.1.2.4 Phone Call: Day 30 (0/+0 Day)

The purpose of this phone contact is to inquire about the subject's general well-being and to assess safety 1 day after the second trial vaccination.

The assessments and procedures are identical to those performed during the phone call on Day 2.

9.1.2.5 Clinic Visit 3: Day 43 (−3/+3 Days)

Review and record any newly reported safety data including solicited and unsolicited AEs, or other AEs (medically-attended AEs, SAEs).

Record concomitant medications and vaccinations, including recurring medications for intermittent conditions.

Perform a symptom-directed physical examination (see Section 9.3.7).

Measure vital signs (body temperature, pulse, blood pressure, see Section 9.3.7).

Collect blood sample for binding antibody testing to N protein of SARS-CoV-2 (~6 mL blood).

Instructions for the subject:

Inform the subject that recording of solicited local and systemic reactions in the eDiary is complete. Remind the subject to continue recording unsolicited AEs (all AEs).

Remind the subject to call the site immediately to report the following:

If he/she experiences any concerning medical event.

Any medically-attended visits that are not routine visits for physical examination or vaccination, such as visits for hospitalization, an emergency room visit, or an otherwise unscheduled visit to or from medical personnel (medical doctor) for any reason.

Experience a serious medical event, have a change in overall health or be diagnosed with a new medical condition by a doctor. These should be reported, regardless of the perceived relationship between the event and the trial vaccine.

Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).

The subject should also be reminded to contact the site immediately if he/she had a positive SARS-CoV-2 test performed outside of the site, whether they were symptomatic (COVID-19 illness) or asymptomatic at the time of the test.

9.1.2.6 Phone Call: Day 57 (−3/+7)

The purpose of this phone contact is to inquire about the subject's general well-being and to assess safety since site visit on Day 43.

During the phone call:

Review and record any newly reported safety data including unsolicited AEs or other AEs (medically-attended AEs, SAEs).

Record concomitant medications and vaccinations, including recurring medications for intermittent conditions.

If the subject reports any concerning local or systemic reactions, or other AEs (e.g., medically-attended AEs, SAEs), these should be followed-up either by a phone call(s) or by an unscheduled site visit based on the judgment of the investigator.

Instructions for the subject:

Inform the subject that reporting of unsolicited AEs is complete.

Remind the subject to call the site immediately to report the following:

If he/she experiences any concerning medical event.

Any medically-attended visits that are not routine visits for physical examination or vaccination, such as visits for hospitalization, an emergency room visit, or an otherwise unscheduled visit to or from medical personnel (medical doctor) for any reason.

Experience a serious medical event, have a change in overall health or be diagnosed with a new medical condition by a doctor. These should be reported regardless of the perceived relationship between the event and the trial vaccine.

Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).

The subject should also be reminded to contact the site immediately if he/she had a positive SARS-CoV-2 test performed outside of the site, whether they were symptomatic (COVID-19 illness) or asymptomatic at the time of the test.

9.1.2.7 Clinic Visit 4: Day 120 (−7/+7)

Review and record any newly reported AEs since the phone call on Day 57 (medically attended AEs, SAEs).

Record concomitant medications and vaccinations, including recurring medications for intermittent conditions.

Perform a symptom-directed physical examination (see Section 9.3.7).

Measure vital signs (body temperature, pulse, blood pressure, see Section 9.3.7).

Instructions for the subject:

Remind the subject to call the site immediately to report the following:

If he/she experiences any concerning medical event.

Any medically-attended visits that are not routine visits for physical examination or vaccination, such as visits for hospitalization, an emergency room visit, or an otherwise unscheduled visit to or from medical personnel (medical doctor) for any reason.

Experience a serious medical event, have a change in overall health or be diagnosed with a new medical condition by a doctor. These should be reported, regardless of the perceived relationship between the event and the trial vaccine.

Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).

The subject should also be reminded to contact the site immediately if he/she had a positive SARS-CoV-2 test performed outside of the site, whether they were symptomatic (COVID-19 illness) or asymptomatic at the time of the test.

9.1.2.8 Clinic Visit 5: Day 211 (−7/+7)

The assessments and procedures are identical to those performed during Clinic Visit 4 on Day 120, except for the below.

Collect a blood sample for binding antibody testing to N protein of SARS CoV-2 (~6 mL blood). 9.1.2.9 Phone Call: Day 302 (−7/+7) The purpose of this phone contact is to inquire about the subject's general well-being and to assess safety since the site visit on Day 211.

During the phone call:

Review and record any newly reported AEs since the site visit on Day 211 (SAEs).

Record concomitant medications and vaccinations, including recurring medications for intermittent conditions.

If the subject reports by phone any concerning AEs, these should be followed-up either by a phone call(s) or by an unscheduled site visit based on the judgment of the investigator.

Instructions for the subject:

Remind the subject to call the site immediately to report the following:

If he/she experiences any concerning medical event.

Any medically-attended visits that are not routine visits for physical examination or vaccination, such as visits for hospitalization, an emergency room visit, or an otherwise unscheduled visit to or from medical personnel (medical doctor) for any reason.

Experience a serious medical event, have a change in overall health or be diagnosed with a new medical condition by a doctor. These should be reported regardless of the perceived relationship between the event and the trial vaccine.

Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).

The subject should also be reminded to contact the site immediately if he/she had a positive SARS-CoV-2 test performed outside of the site, whether they were symptomatic (COVID-19 illness) or asymptomatic at the time of the test.

9.1.2.10 End of Trial Clinic Visit: Day 393 (−0/+21 Days)

The end of trial visit will be performed on Day 393, 1 year after the last trial vaccine administration. If possible, this visit should include subjects who prematurely discontinued vaccination during the trial. The following assessments should be performed:

Review and record any newly reported AEs since the phone contact on Day 302 (SAEs).

Record concomitant medications and vaccinations, including recurring medications for intermittent conditions.

Perform a complete physical examination, including height and weight (see Section 9.3.7).

Measure vital signs (body temperature, pulse, blood pressure, see Section 9.3.7).

Collect a blood sample for binding antibody testing to N protein of SARS CoV-2 (~6 mL blood).

Inform the subject that they have completed the main part of the trial and that the extension part of the trial will now begin (see Section 9.1.4).

9.1.3 Phase 3 Subjects

Approximately 32,500 subjects, 18 years of age and older, will be enrolled into Phase 3.

9.1.3.1 Clinic Visit 1: Day 1—First Trial Vaccination

Note that procedures to establish subject eligibility, recording of demographic information and medical history may be performed within 21 days prior to trial vaccine administration, i.e., spread out over more than 1 day. However, if all information is available and assessments and procedures can be performed, eligibility can be established on the same day of trial vaccine administration. All eligibility criteria must be reviewed prior to trial vaccine administration on Day 1.

Pre-Vaccination Procedures

Obtain the signed informed consent form.

Signed informed consent must be obtained prior to the subject entering into the trial, and before any protocol-directed procedures are performed (see Section 12.4).

By signing the informed consent form, the subject voluntarily agrees to participate in the HERALD Trial CV-NCOV-004 and its 1 year Extension Study for a total of approximately 2 years.

Review inclusion/exclusion criteria (see Section 6.1 and 6.2) and review prohibited medications listed as an exclusion criterion (see Section 6.2).

Record demographic information.

Record medical history.

Record concomitant medications and vaccinations, including recurring medications for intermittent conditions, if taken within 6 months prior to enrollment in this trial.

Perform a complete physical examination, including height and weight (see Section 9.3.7). If the complete physical examination to establish eligibility was performed within 21 days prior to trial vaccine administration, a symptom-directed physical examination should be performed on the day of vaccination prior to trial vaccine administration.

Measure vital signs (body temperature, pulse, blood pressure, see Section 9.3.7).
Perform urine pregnancy test in females of childbearing potential
Collect a pre-vaccination blood sample for binding antibody testing to N protein of SARS-CoV-2 (~6 mL blood).
Vaccination Procedure
Review criteria for delay or cancellation of vaccination. See Sections 6.3 and 8.1 for an overview of the criteria leading to delay or cancellation of vaccine administration. In case of delay, the vaccination should take place within the allowed time windows. The reasons for delay or cancellation should be documented in the subject chart.
Administer the trial vaccine dose according to the subject's assignment.
Post-Vaccination Procedures
Observe the subject on site for at least 30 minutes following vaccination for safety monitoring. At the end of the observation period:
Measure vital signs (body temperature, pulse, blood pressure, see Section 9.3.7).
The subject may not be discharged until vital signs are within normal range or have returned to pre-vaccination levels.
Record the occurrence of any new AEs following trial vaccination.
Instructions for the subject:
Remind the subject to call the site immediately to report the following:
If he/she experiences any concerning local or systemic reactions or other medical event.
Any medically-attended visits that are not routine visits for physical examination or vaccination, such as visits for hospitalization, an emergency room visit, or an otherwise unscheduled visit to or from medical personnel (medical doctor) for any reason.
Experience a serious medical event, have a change in overall health or be diagnosed with a new medical condition by a doctor. These should be reported regardless of the perceived relationship between the event and the trial vaccine.
Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).
The subject should also be reminded to contact the site immediately if he/she had a positive SARS-CoV-2 test performed outside of the site, whether they were symptomatic (COVID-19 illness) or asymptomatic at the time of the test.
Note: Subjects without symptoms may have been tested for several reasons, for example, close exposure to a known person with SARS-CoV-2 infection or as part of their routine screening as a healthcare provider).

9.1.3.2 Clinic Visit 2: Day 29—Second Trial Vaccination (−3/+7 Days)
Pre-Vaccination Procedures
Review and record any newly collected safety data including medically-attended AEs and SAEs.
Record concomitant medications and vaccinations, including recurring medications for intermittent conditions.
Perform a symptom-directed physical examination (see Section 9.3.7).
Measure vital signs (body temperature, pulse, blood pressure, see Section 9.3.7).
Perform urine pregnancy test in females of childbearing potential.
Vaccination Procedure
Review criteria for delay or cancellation of vaccination. See Sections 6.3 and 8.1 for an overview of the criteria leading to delay or cancellation of vaccine administration. In case of delay, the vaccination should take place within the allowed time windows. The reasons for delay or cancellation should be documented in the subject chart.
Administer the trial vaccine dose according to the subject's assignment.
Post-Vaccination Procedures
Observe the subject on site for at least 30 minutes following vaccination for safety monitoring. At the end of the observation period:
Measure vital signs (body temperature, pulse, blood pressure, see Section 9.3.7).
The subject may not be discharged until vital signs are within normal range or have returned to pre-vaccination levels.
Record the occurrence of any new AEs following trial vaccination.
Instructions for the subject:
Remind the subject to call the site immediately to report the following:
If he/she experiences any concerning local or systemic reactions or other medical event.
Any medically-attended visits that are not routine visits for physical examination or vaccination, such as visits for hospitalization, an emergency room visit, or an otherwise unscheduled visit to or from medical personnel (medical doctor) for any reason.
Experience a serious medical event, have a change in overall health or be diagnosed with a new medical condition by a doctor. These should be reported regardless of the perceived relationship between the event and the trial vaccine.
Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).
The subject should also be reminded to contact the site immediately if he/she had a positive SARS-CoV-2 test performed outside of the site, whether they were symptomatic (COVID-19 illness) or asymptomatic at the time of the test.

9.1.3.3 Clinic Visit 3: Day 43 (−3/+3 days)
Review and record any newly collected safety data including medically-attended AEs and SAEs.
Record concomitant medications and vaccinations, including recurring medications for intermittent conditions.
Perform a symptom-directed physical examination (see Section 9.3.7).
Measure vital signs (body temperature, pulse, blood pressure, see Section 9.3.7).
Collect a blood sample for binding antibody testing to N protein of SARS CoV-2 (~6 mL blood).

Instructions for the subject:
Remind the subject to call the site immediately to report the following:
If he/she experiences any concerning local or systemic reactions or other medical event.
Any medically-attended visits that are not routine visits for physical examination or vaccination, such as visits for hospitalization, an emergency room visit, or an otherwise unscheduled visit to or from medical personnel (medical doctor) for any reason.
Experience a serious medical event, have a change in overall health or be diagnosed with a new medical condition by a doctor. These should be reported regardless of the perceived relationship between the event and the trial vaccine.
Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).
The subject should also be reminded to contact the site immediately if he/she had a positive SARS-CoV-2 test performed outside of the site, whether they were symptomatic (COVID-19 illness) or asymptomatic at the time of the test.

9.1.3.4 Phone Call: Day 57 (−3/+7 Days) and Day 120 (−7/+7 Days)

The purpose of these phone contacts is to inquire on the subject's general well-being and to assess safety since the last phone contact or site visit.
During the phone call:
Review and record any newly reported AEs since the site visit or phone call (medically attended AEs, SAEs).
Record concomitant medications and vaccinations, including recurring medications for intermittent conditions.
If the subject reports by phone any concerning AEs, these should be followed-up either by a phone call(s) or by an unscheduled site visit based on the judgment of the investigator.
Instructions for the subject:
Remind the subject to call the site immediately to report the following:
If he/she experiences any concerning medical event.
Any medically-attended visits that are not routine visits for physical examination or vaccination, such as visits for hospitalization, an emergency room visit, or an otherwise unscheduled visit to or from medical personnel (medical doctor) for any reason.
Experience a serious medical event, have a change in overall health or be diagnosed with a new medical condition by a doctor. These should be reported regardless of the perceived relationship between the event and the trial vaccine.
Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information (see Section 9.2.1 and Section 9.5).
The subject should also be reminded to contact the site immediately if he/she had a positive SARS-CoV-2 test performed outside of the site, whether they were symptomatic (COVID-19 illness) or asymptomatic at the time of the test.

9.1.3.5 Clinic Visit 4: Day 211 (−7/+7 Days)
The assessments and procedures are identical to those performed during the clinical visit on Day 43.

9.1.3.6 Phone Call: Day 302 (−7/+7 Days)
The purpose of this phone contact is to inquire on the subject's general well-being and to assess safety since the last site visit on Day 211.
The assessments and procedures are identical to those performed during the phone calls on Day 57 and Day 120.

9.1.3.7 End of Trial Clinic Visit: Day 393 (−0/+21 Days)
The end of trial visit will be performed on Day 393, 1 year after the last trial vaccine administration. If possible, this visit should include subjects who prematurely discontinued vaccination during the trial. The following assessments should be performed:
Review and record any newly reported AEs since the phone contact on Day 302 (SAEs).
Record concomitant medications and vaccinations, including recurring medications for intermittent conditions.
Perform a complete physical examination, including height and weight (see Section 9.3.7).
Measure vital signs (body temperature, pulse, blood pressure, see Section 9.3.7).
Collect a blood sample for binding antibody testing to N protein of SARS CoV-2 (~6 mL blood).
Inform the subject that they have completed the main part of the trial and that the extension part of the trial will now begin (see Section 9.1.4).

9.1.4 Extension Study (Up to 1 Year Duration)
General instructions for all subjects:
Inform the subject that the Extension Study will begin on the last day (Day 393) of the main trial. Explain that the duration of the trial is planned for 1 year, but may terminate early if CVnCoV meets regulatory approval and subjects in the placebo group are offered vaccination with CVnCoV. The trial may also terminate early if another effective vaccine is deployed locally.
Instructions for Phase 2b subjects who participated in the Immunogenicity Subset:
Inform subjects that the following assessments and procedures will be performed:
Return to the site every 3 months (Day 484, Day 575, Day 665, and Day 757) for blood samples to be taken for evaluation of long-term persistence of binding antibodies to the RBD of S protein of SARS-CoV-2 and SARS-CoV-2 viral neutralizing antibodies.
COVID-19 case detection to assess long-term efficacy.
Collection of AESIs and SAEs to assess long-term safety.
Instructions for Phase 2b Non-Immunogenicity subjects and Phase 3 subjects.
Inform subjects that the following assessments and procedures will be performed:
Phone contact every 3 months (Day 484, Day 575, Day 665, and Day 757) to ensure collection of AESIs and SAEs to assess long-term safety.
COVID-19 case detection to assess long-term efficacy.
Remind the subject to call the site immediately to report the following:
If he/she experiences any concerning medical event.
Any medically-attended visits that are not routine visits for physical examination or vaccination, such as visits for hospitalization, an emergency room visit, or an otherwise unscheduled visit to or from medical personnel (medical doctor) for any reason.

Experience a serious medical event, have a change in overall health or be diagnosed with a new medical condition by a doctor. These should be reported regardless of the perceived relationship between the event and the trial vaccine.

Remind the subject to contact the site immediately if he/she has any of the symptoms suggestive of COVID-19. In addition, subjects will be messaged up to twice a week to provide a yes or no response to having COVID-19 symptoms. Those who respond "yes" will be contacted by trial staff for follow-up information.

The subject should also be reminded to contact the site immediately if he/she had a positive SARS-CoV-2 test performed outside of the site, whether they were symptomatic (COVID-19 illness) or asymptomatic at the time of the test.

9.2 Efficacy Assessments 9.2.1 COVID-19 Cases

COVID-19 case ascertainment will occur in identical manner in both the Phase 2b and Phase 3 parts of the trial. Case detection will begin with the identification of subjects reporting at least 1 symptom from a standardized list of symptoms consistent with COVID 19 disease. Based on a phone interview with trial staff, subjects suspected of having COVID-19 disease will undergo testing for SARS-CoV-2 infection, consisting of a rapid antigen test performed locally by the trial staff and a molecular-based RT-PCR test performed at a designated central laboratory. The testing strategy is described in Section 9.5. If the subject is confirmed to have COVID-19, subjects will be followed until resolution of their disease, even if the initial presentation is considered as mild. If the subject is hospitalized, the subject's progress must continue to be followed by the Investigator and a medical/discharge summary must be obtained at the end of the hospitalization.

9.2.1.1 Case Detection 9.2.1.1.1 Routine Surveillance for COVID-19

During all site visits and phone calls, subjects will be reminded to contact the site if they have any of the following symptoms*:

Fever or chills; Shortness of breath or difficulty breathing; New loss of taste or smell; Cough; Fatigue; Muscle or body aches; Headache; Sore throat; Congestion or runny nose; Nausea or vomiting; Diarrhea

*FDA Development and Licensure of Vaccines to Prevent COVID-19 guidance (US Department of Health and Human Services. Food and Drug Administration (FDA). Guidance for Industry. Development and Licensure of Vaccines to Prevent COVID 19. 2020. Available on the world wide web at fda.gov/regulatory-information/search-fda-guidance-documents/development-and-licensure-vaccines-prevent-covid-19; Accessed October 2020, incorporated herein by reference).

Subjects will also be messaged up to twice a week to provide a yes or no response to having COVID-19 symptoms. For both of the trial vaccinations, messaging will not begin until 4 days after vaccination to avoid confusing vaccine-associated reactions occurring during this time period (e.g., fever, chills, headache, fatigue, myalgia) with potential COVID-19 symptoms.

Those who report symptoms either at the site visit or by phone call, or respond "yes" to having symptoms by messaging will be contacted by trial staff for a follow-up phone interview. The trial staff will use a scripted interview (in which he/she has been trained on) to collect information about the subject's medical condition, which will be used to determine the probability of the subject having COVID-19. If the subject is suspected of having COVID-19 illness, he/she will undergo testing for SARS-CoV-2 infection (see next section). If suspicion is low, then a subsequent phone call(s) will be performed to assess whether the subject's illness and symptoms have progressed and if the suspicion of COVID-19 has reached a sufficient level to test the subject. Based on clinical judgment, phone contact may be made as frequently as daily. All symptomatic subjects will be provided a thermometer and oxygen saturation monitor for home use. Trial staff will instruct subjects to take their oral body temperature and oxygen saturation levels at least 3 to 4 times per day, or whenever they feel symptomatic.

The testing strategy for SARS-CoV-2 infection is presented in Section 9.5. Testing will consist of 2 tests: a rapid antigen test performed locally by the trial staff and a molecular-based RT-PCR test performed at a designated central laboratory. Depending on the Investigator and his/her facility and trial staff, nasopharyngeal swab samples for testing will be collected either at the site or at a home visit. The visit to the site or home visit by trial staff will be considered an "Illness Visit" and documented as such in the eCRF.

If the subject is virologically-confirmed to have COVID-19 by a positive RT-PCR test, subjects will be followed until resolution of their disease, even if the initial presentation is considered as mild. If the subject is hospitalized, the subject's progress must continue to be followed by the Investigator and a discharge summary must be obtained at the end of the hospitalization. Information on clinical symptoms and signs, their duration and severity, and treatment and outcome of the COVID-19 episode will be documented by trial staff and recorded in the eCRF.

Upon resolution, subjects will continue to be followed in the same manner as those who have not presented with COVID-19 (i.e. they will return to routine case surveillance). A second episode of COVID-19 in a subject with prior disease will not be counted as a primary efficacy case, but will be included in the exploratory objective assessing the occurrence of second episodes of COVID-19 in vaccinated subjects.

If the subject is not virologically-confirmed by RT-PCR testing, he/she will return to routine surveillance for COVID-19 disease as a subject who is naïve to SARS-CoV-2 infection (unless determined otherwise by a seropositive test to the N protein).

9.2.1.1.2 Non-Routine Surveillance for COVID-19 (Positive Test Outside of the Site)

Subjects will be reminded to contact the site immediately if he/she has a positive SARS CoV-2 test performed outside of the site, whether they were symptomatic (COVID 19 illness) or asymptomatic at the time of the test.

If the subject was symptomatic, trial staff will use the scripted interview to collect information about the subject's COVID-19 symptoms and medical condition. The subject should be retested as soon as feasible to confirm the result. A nasopharyngeal swab sample should be sent to the Sponsor-designated central laboratory for RT-PCR testing; the RT-PCR test result will be considered definitive as a virologically-confirmed case of COVID-19. If the subject is confirmed to have COVID-19, subjects will be followed until resolution of their disease, as described above for subjects who were detected by routine surveillance.

If the subject is not virologically-confirmed by RT-PCR testing, he/she will return to routine surveillance for COVID-19 disease as a subject who is naïve to SARS- CoV-2 infection (unless determined otherwise by a seropositive test to the N protein).

9.2.1.2 Definition of Virologically-Confirmed COVID-19 Case

A virologically-confirmed case of COVID-19 is defined as a positive SARS-CoV-2 specific RT-PCR test in a person with clinically symptomatic disease consisting of 1 or more of the following symptoms (based on the same screening symptoms as above):

Fever or chills; Shortness of breath or difficulty breathing; New loss of taste or smell; Cough; Fatigue; Muscle or body aches; Headache; Sore throat; Congestion or runny nose; Nausea or vomiting; Diarrhea This definition is intended to capture all severities of virologically-confirmed clinically symptomatic cases of COVID-19. As such, COVID-19 cases classified by severity (e.g., mild or severe) will be a subset of these cases.

9.2.1.3 COVID-19 Case Definition for Co-Primary Efficacy Analysis

For the primary analysis of efficacy, the case must meet the following criteria:

Must be a virologically-confirmed case of COVID-19 defined as a positive SARS CoV 2 specific RT-PCR test in a person with clinically symptomatic COVID-19, as defined above in Section 9.2.1.2.

For the primary efficacy analyses, COVID-19 cases will be categorized as "any severity" or of "moderate to severe" severity.

Symptom onset must have occurred≥15 days following the second trial vaccination.

The subject must not have a history of virologically-confirmed COVID-19 illness at enrollment or have developed a case of virologically-confirmed COVID-19 before 15 days following the second trial vaccination {see Section 10.2.3, Efficacy Analysis Set (EAS) for more details}.

The subject must have been SARS-CoV-2 naïve at baseline and Day 43 (defined as seronegative to N protein in the blood samples collected at baseline and Day 43).

The primary efficacy cases must be confirmed by the Adjudication Committee.

Day 43 is 14 days post-second dose which allows the immune response to CVnCoV to mature and reach its height following the second dose. As such, COVID-19 case ascertainment starting the next day at ≥15 days represents the evaluation of full VE of CVnCoV against COVID-19 disease.

9.2.1.4 Adjudication of COVID-19 Cases

An independent Committee of clinicians will be formed to adjudicate COVID-19 cases. The Committee will be blinded to the treatment assignment of the subject. The cases will be adjudicated by the members with respect to the following questions consistent with the endpoints of the trial.

Is the case a virologically-confirmed case of COVID-19 defined as a positive SARS CoV-2 specific RT-PCR test in a person with clinically symptomatic COVID-19 with 1 or more of the symptoms listed above in Section 9.2.1.2.

Was the RT-PCR test performed at the CureVac designated central laboratory?

Was the symptom onset of the case≥15 days following the second vaccination? Or did it occur before 15 days following the second trial vaccination?

Was the subject naïve or non-naïve to SARS-CoV-2 at baseline and Day 43? (defined as being seronegative or seropositive to the SARS-CoV-2 N protein).

Was the subject 18 to 60 years of age or ≥61 years of age?

Was the subject asymptomatic? If asymptomatic, was the RT-PCR test positive≥15 days following the second vaccination or before?

Was it a mild or severe case of COVID-19 based on the provided clinical definitions?

Did the subject require supplemental oxygenation? What type of oxygen support did the subject receive?

Was the subject hospitalized? Was the subject admitted to the intensive care unit?

Did the subject die? Due to COVID-19 or other cause?

9.2.2 Asymptomatic Cases of SARS-CoV-2 Infection

There will be no active surveillance in this trial for asymptomatic SARS-CoV-2 infections. Subjects will be reminded to contact the site immediately if he/she had a positive SARS CoV-2 test performed outside of the site, whether they were symptomatic (COVID 19 illness) or asymptomatic at the time of the test. Subjects without symptoms may have been tested for several reasons, for example, close exposure to a known person with SARS-CoV-2 infection or as part of their routine screening as a healthcare provider.

If the subject was asymptomatic, trial staff will contact the subject immediately to collect information about the positive SARS-CoV-2 test the subject reported for information to be collected). The subject should be retested as soon as feasible to confirm the result. A nasopharyngeal swab sample should be sent to the Sponsor-designated central laboratory for RT-PCR testing; a positive RT-PCR test result will be considered definitive as a virologically-confirmed case of SARS-CoV-2 infection.

If the subject is confirmed to have SARS-CoV-2 infection, the subject will be followed by trial staff for at least 2 weeks for the development of any COVID-19 symptoms, to ensure that this is an asymptomatic infection. If the subject develops COVID-19, he/she will be followed-up as a COVID-19 case. If the subject is confirmed to be asymptomatic, information will be collected by the trial staff and documented on the appropriate eCRF page.

If the subject is not virologically-confirmed by RT-PCR testing, he/she will return to routine surveillance for COVID-19 disease as a subject who is naïve to SARS-CoV-2 infection (unless determined otherwise by a seropositive test to the N protein).

9.3 Safety Assessments

The safety, reactogenicity, and tolerability of a 2-dose schedule of CVnCoV will be assessed as described below.

9.3.1 Safety Assessments Specific for Subjects in Phase 2b

Reactogenicity will be assessed daily on each vaccination day and the following 7 days by collection of solicited local AEs (injection site pain, redness, swelling, and itching) and systemic AEs (fever, headache, fatigue, chills, myalgia, arthralgia, nausea/vomiting, and diarrhea) using eDiaries. In addition, other indicators of safety will be collected (e.g., body temperature).

The eDiary will also be used as a memory aid for the subject for the collection of unsolicited AEs on each vaccination day and the following 28 days.

9.3.2 Safety Assessments for all Subjects in Phase 2b and Phase 3

Medically-attended AEs will be collected through 6 months after the second trial vaccination.

AESIs will be collected through 1 year after the second trial vaccination. AESIs to be monitored include pIMDs, AESIs for SARS-CoV-2 vaccines, and non-serious intercurrent medical conditions that may affect the immune response to vaccination.

SAEs will be collected through 1 year after the second trial vaccination.

AEs leading to vaccine withdrawal or trial discontinuation will be collected through 1 year after the second trial vaccination.

{If the subject does not receive their second trial vaccination, the AE follow-up time (6 months or 1 year) will be determined based on the date scheduled for their second vaccination on Day 29}.

The eDiary will be used as a memory aid for the subject for the collection of medically attended AEs, AESIs, and SAEs.

9.3.3 Safety Assessments for Subjects in the 1 Year Extension Study

AESIs and SAEs will be collected for up to 1 additional year in the Extension Study.

The eDiary will be used as a memory aid for the subject for the collection of AESIs and SAEs.

9.3.4 Adverse Events

Definitions of AEs/SAEs, procedures for recording, evaluating, follow-up and reporting of AEs/SAEs/pregnancy/overdose, as well as assessments of intensity and causality of AEs.

It is important to note that COVID-19 illness and its complications/sequelae are consistent with the efficacy endpoints of the trial and, as such, should not be recorded as AEs. These data will be captured on the relevant eCRF pages for cases of COVID-19 illness that occur in the trial, which are expected outcomes of the trial. Therefore, COVID-19 illness and its complications/sequelae will not be reported according to the standard expedited process for SAEs, even though the event may meet the criteria for an SAE.

9.3.4.1 Solicited Adverse Events

An eDiary will be distributed to all subjects in Phase 2b for collection of solicited local AEs (injection site pain, redness, swelling and itching) and solicited systemic AEs (fever, headache, fatigue, chills, myalgia, arthralgia, nausea/vomiting and diarrhea) on the day of vaccination and the following 7 days. Subjects will be given a thermometer to measure body temperature orally and a measuring tape to determine the size of local injection-site reactions. Subjects will be instructed on how to enter the solicited AEs daily for 7 days in the eDiary.

Solicited AEs will be assessed on an intensity scale of absent, mild, moderate and severe (Table A and Table B, above). By definition, all local solicited AEs are considered related to trial vaccination. For solicited systemic AEs, the Investigator will assess the relationship between trial vaccine and occurrence of each AE and make an assessment of intensity for each AE (Table B).

If concerning to the subject or of prolonged duration, solicited Grade 3 AEs should be reported to the Investigator immediately. In case of related Grade 3 solicited AEs reported for more than 1 day on the eDiary, the subject will be questioned to establish the total duration of the AE as exactly as possible.

9.3.4.2 Unsolicited Adverse Events and Serious Adverse Events

Unsolicited AEs occurring on the day of vaccination and the following 28 days will be recorded by Phase 2b subjects for each of the 2 trial vaccinations.

For all subjects in Phase 2b and Phase 3, medically-attended AEs will be collected through 6 months after the second trial vaccination. AESIs will be collected through 1 year after the second trial vaccination (see Section 9.3.4.3). SAEs will be collected through 1 year after the second trial vaccination. In the Extension Study, AESIs and SAEs will continue to be collected for an additional 1 year.

Medically-attended AEs are defined as AEs with medically-attended visits that are not routine visits for physical examination or vaccination, such as visits for hospitalization, an emergency room visit, or an otherwise unscheduled visit to or from medical personnel (medical doctor) for any reason.

The occurrence of AEs (serious and non-serious) will be assessed by non-directive questioning of the subject at each visit. AEs volunteered by the subject during or between visits as eDiary entries or detected through observation, physical examination, laboratory test, or other assessments during the entire trial, will be recorded in the eCRF. Subjects should be instructed to report immediately any AEs with serious symptoms, subjective complaints or objective changes in their well-being to the Investigator or the site personnel, regardless of the perceived relationship between the event and the trial vaccine.

The Investigator will assess the relationship between trial vaccine and occurrence of each AE/SAE.

Non-serious intercurrent medical conditions that may affect the immune response to vaccination will also be collected throughout the trial.

9.3.4.3 Adverse Events of Special Interest

AESIs will be collected through 1 year after the second trial vaccination in the HERALD Trial CV NCOV 004 and up to 1 additional year in the Extension Study. The following events will be considered as AESI during this trial:

AEs with a suspected immune-medicated etiology of potential immune-mediated diseases (pIMDs) which are defined supra.

Celiac disease; Crohn's disease; Ulcerative colitis; Ulcerative proctitis; Autoimmune cholangitis; Autoimmune hepatitis; Primary biliary cirrhosis; Primary sclerosing cholangitis; Addison's disease; Autoimmune thyroiditis (including Hashimoto thyroiditis; Diabetes mellitus type I; Grave's or Basedow's disease; Antisynthetase syndrome; Dermatomyositis; Juvenile chronic arthritis (including Still's disease); Mixed connective tissue disorder; Polymyalgia rheumatic; Polymyositis; Psoriatic arthropathy; Relapsing polychondritis; Rheumatoid arthritis; Scleroderma, (e.g., including diffuse systemic form and CREST syndrome); Spondyloarthritis, (e.g., including ankylosing spondylitis, reactive arthritis (Reiter's Syndrome) and undifferentiated spondyloarthritis); Systemic lupus erythematosus; Systemic sclerosis; Acute disseminated encephalomyelitis, (including site specific variants (e.g., non-infectious encephalitis, encephalomyelitis, myelitis, myeloradiculomyelitis)); Cranial nerve disorders, (e.g., including paralyses/paresis (e.g., Bell's palsy)); Guillain-Barré syndrome, (e.g., including Miller Fisher syndrome and other variants); Immune-mediated peripheral neuropathies, Parsonage-Turner syndrome and plexopathies, (e.g., including chronic inflammatory demyelinating polyneuropathy, multifocal motor neuropathy, and polyneuropathies associated with monoclonal gammopathy); Multiple sclerosis; Narcolepsy; Optic neuritis; Transverse Myelitis; Alopecia areata; Autoimmune bullous skin diseases, including pemphigus, pemphigoid and dermatitis herpetiformis; Cutaneous lupus erythematosus; Erythema nodosum; Morphoea; Lichen planus; Psoriasis; Sweet's syndrome; Vitiligo; Large vessels vasculitis (e.g., including: giant cell arteritis such as Takayasu's arteritis and temporal arteritis); Medium sized and/or small vessels vasculitis (e.g., including: polyarteritis nodosa, Kawasaki's disease, microscopic polyangiitis, Wegener's granulomatosis, Churg-Strauss syndrome (allergic granulomatous angiitis), Buerger's disease thromboangiitis obliterans, necrotizing vasculitis and anti-neutrophil cytoplasmic antibody (ANCA) positive vasculitis (type unspecified), Henoch-Schonlein purpura, Behcet's syndrome, leukocytoclastic vasculitis); Antiphospholipid syndrome; Autoimmune hemolytic anemia; Autoimmune glomerulonephritis (including IgA nephropathy, glomerulonephritis rapidly progressive, membranous glomerulonephritis, membranoproliferative glomerulonephritis, and mesangioproliferative glomerulonephritis); Autoimmune myocarditis/cardiomyopathy; Autoimmune thrombocytopenia; Goodpasture syndrome; Idiopathic pulmonary fibrosis; Pernicious anemia; Raynaud's phenomenon; Sarcoidosis; Sjögren's syndrome; Stevens-Johnson syndrome; Uveitis).

Other AEs relevant to SARS-CoV-2 vaccine development or the target disease include:

Anaphylaxis; Vasculitides; Enhanced disease following immunization; Multisystem inflammatory syndrome in children; Acute Respiratory Distress Syndrome; COVID-19 disease; Acute cardiac injury; Microangiopathy; Heart failure and cardiogenic shock; Stress cardiomyopathy; Coronary artery disease; Arrhythmia; Myocarditis, pericarditis; Thrombocytopenia; Deep vein thrombosis; Pulmonary embolus; Cerebrovascular stroke; Limb ischemia; Hemorrhagic disease; Acute kidney injury; Liver injury; Generalized convulsion; Guillain-Barré Syndrome; Acute disseminated encephalomyelitis; Anosmia, ageusia; Meningoencephalitis; Chilblain-like lesions; Single organ cutaneous vasculitis; Erythema multiforme; Serious local/systemic AR following immunization Non-serious intercurrent medical conditions that may affect the immune response to vaccination will also be collected throughout the trial.

9.3.5 Pregnancies

Pregnancy is an exclusion criterion for enrollment in this trial, but subjects could potentially become pregnant during their active participation in this trial.

9.3.6 Safety Laboratory Assessments

A urine sample for pregnancy testing will be taken from women of childbearing potential on Day 1 prior to trial vaccination to establish eligibility. A urine pregnancy test will also be performed before the second trial vaccination on Day 29 to continue to determine eligibility.

9.3.7 Vital Signs and Physical Examination

At all trial visits for Phase 2b and Phase 3, vital signs (body temperature, systolic/diastolic blood pressure and pulse) will be recorded in a standardized manner after the subject has rested in the sitting position for 5 minutes.

At the first trial visit on Day 1 and end of trial visit on Day 393 for all subjects in the HERALD Trial CV NCOV-004 a complete physical examination will be performed, including examination of general appearance, eyes/ears/nose/throat, head/neck/thyroid, lymph node areas, cardiovascular system, lung/chest, abdomen and genitourinary system, extremities and neurological examination, skin examination, measurement of weight and height. At all other trial visits, a symptom directed physical examination will be performed.

9.3.8 Medical and Surgical History

All significant findings and pre-existing conditions present in a subject prior to enrollment must be reported on the relevant medical history/current medical conditions screen of the eCRF.

Information should be provided on medical and surgical history and concomitant medical conditions specifying those ongoing on Day 1.

9.3.9 Monitoring Committees 9.3.9.1 Data and Safety Monitoring Board (DSMB)

An independent DSMB will be convened to i) oversee the safety of subjects participating in this trial, HERALD: CV-NCOV-004; ii) to assess the progress and conduct of the trial; iii) to review the cumulative safety data from the trial; iv) to perform an ongoing review of AEs of potential safety concern (see Section 5.5.2); and v) to make recommendations to the Sponsor whether to continue, modify, or pause the trial (see Section 5.5.2).

The DSMB will have regularly scheduled meetings to perform these responsibilities. During these meetings, the DSMB will also be informed of the safety data being generated in other ongoing clinical trials of CVnCoV. As described in Section 5.5.2, to further ensure subject safety on an ongoing basis, a listing of AEs of potential safety concern will be routinely monitored by the Chair of the DSMB (or designee) at regular intervals. As described in Section 7.3.2, the DSMB may request unblinding of an individual subject or a specific dataset at any time during the trial.

In addition to safety data, the DSMB will be asked to review efficacy data at the interim analyses or possibly at other time points during the trial for a continued assessment of the risk-benefit of the trial. As part of the risk-benefit analysis, the DSMB will periodically monitor COVID-19 cases for signals of VDE. The DSMB will also be asked to perform an unblinded review(s) of the incidence rate of COVID-19 cases to recommend an increase(s) in sample size, if needed.

The DSMB Charter will describe in detail the composition and objectives of the DSMB; the responsibilities of the DSMB, CureVac, and CRO; the schedule and conduct of the DSMB meetings; and the datasets to be reviewed. The Charter will contain the statistical analysis plan (SAP) for the DSMB.

9.3.9.2 Adjudication Committee

An independent Committee of clinicians will be formed to adjudicate COVID-19 cases for assessment of the primary endpoint. The Committee will be blinded to the treatment assignment of the subject. The cases will be adjudicated by the members with respect to the questions presented in Section 9.2.1.4. The schedule of the meetings and approach to adjudication of cases will be defined in the Charter. The Committee Chair will attend the DSMB meetings as an ad hoc member.

9.4 Immunogenicity Assessments

Because the immunogenicity results would unblind the subject's treatment assignment, the laboratory performing the assays will keep the results in strict confidence. An unblinded person, named at the start of the trial and independent of the conduct of the trial, will periodically review the quality of the immunogenicity data. This person will maintain the results in strict confidence.

9.4.1 Antibody Responses to CVnCoV Vaccination (RBD of S Protein and Viral Neutralizing Antibodies)

Antibody responses to CVnCoV vaccination will only be evaluated in the Phase 2b part of the trial and only for subjects in the Immunogenicity Subset at the time points. In the Extension Study, antibody persistence will be evaluated every 3 months in the second year post-vaccination.

The immune response induced by vaccination with CVnCoV will be evaluated by 2 assays:

Binding antibodies to the SARS-CoV-2 RBD of the S protein measured in serum by immunoassay.

Viral neutralizing antibodies directed against SARS-CoV-2 measured in serum by a functional activity assay.

9.4.2 Antibody Responses to SARS-CoV-2 (N Protein)

Antibody responses to SARS-CoV-2 will be evaluated in all parts of the trial and for all subjects by measuring the binding antibodies to the SARS-CoV-2 N protein (virus antigen not contained in the vaccine construct) at the time points specified above and will be performed by immunoassay.

As a measure of prior infection with SARS-CoV-2, serological status to the N protein will be used for the following:

1. To determine, retrospectively, if subjects were naïve or non-naïve to SARS-CoV-2 infection at trial entry and on Day 43.

a. For evaluation of the efficacy of a 2-dose schedule of CVnCoV in naïve subjects, subjects would have to be seronegative to the N protein at baseline and Day 43.

b. For evaluation of the efficacy after the first dose of CVnCoV in naïve subjects, subjects would have to be seronegative to the N protein at baseline only.

2. To determine if vaccination with a 2-dose schedule of CVnCoV can reduce infection with SARS-CoV-2 by measuring seroconversion to the N protein in seronegative subjects during the trial period. As described above in 1a, these subjects would have to be seronegative to the N protein at baseline and Day 43.

9.4.3 Antibody Responses to CVnCoV Vaccination in Subjects Who Develop a Case of COVID-19

For all cases of COVID-19 that occur in the trial, the antibody response to trial vaccination will be determined in the subject's blood samples collected on Day 1 (pre vaccination baseline), Day 43, Day 211, and Day 393 of the trial. These assays will only need to be performed for subjects in the Phase 2b part who are not in the Immunogenicity Subset and for Phase 3 subjects. Subjects in the Phase 2b Immunogenicity Subset will already have these performed as part of the cohort. These results will be used to explore correlates of protective immunity induced by CvnCoV vaccination.

9.4.4 Cell-Mediated Immunity

CMI will be evaluated in 400 subjects: 200 who receive CVnCoV and 200 who receive placebo. In each CVnCoV and placebo group, 100 subjects will be 18 to 60 years of age and 100 subjects≥61 years of age. This is intended to be carried out in one clinical site in Europe and another in Latin American country (approximately 100 CVnCoV+100 placebo subjects participating at each site).

The frequency and functionality of SARS-CoV-2 RBD of S-specific T-cell response after antigen stimulation will be determined in PBMC in comparison to baseline. For example, ICS to investigate Th1 response and production of Th2 markers will be used to investigate whether vaccination induces a Th1 shift from the baseline. Further high profiling T cell immune responses may be investigated with other technologies such as ELISpot or CyTOF, analysis of genomic biomarkers or any other established assays. CMI assessment will be performed on Day 1 (baseline), Day 29, Day 43, Day 120 and Day 211. Note that testing on Day 120 and Day 211 will only be performed on subjects who are determined as T-cell responders on Day 29 and/or Day 43.

9.5 Testing for SARS-CoV-2 Infection 9.5.1 Virological Confirmation of COVID-19 Disease During the trial, subjects clinically suspected of having COVID-19 disease will undergo testing for the SARS-CoV-2 virus as described below. Sample collection for the tests may be performed at the site or at a home visit by trial staff. Ideally, samples should be collected within 5 days of symptom onset. The test results will be documented on the appropriate eCRF page.

Subjects with a clinical suspicion of COVID-19 will undergo testing for SARS-CoV-2 infection using a rapid antigen test performed at the site with the results provided to the subject. Nasopharyngeal swabs will be used to collect samples for the rapid antigen test.

Regardless of the result of the rapid antigen test, a nasopharyngeal swab sample collected at the same time will be sent to a central laboratory to perform a SARS CoV 2 specific RT-PCR test. The RT-PCR test result will be considered definitive for SARS-CoV-2 infection. In the unlikely event that only 1 sample can be collected from the subject, the sample should be tested by RT-PCR at the central laboratory.

If the RT-PCR test is negative, but COVID-19 is still suspected based on the subject's exposure history and clinical presentation, another nasopharyngeal swab sample should be taken as soon as feasible and sent to the central laboratory for RT-PCR testing. The RT-PCR retest result will be considered definitive for SARS CoV-2 infection.

Subjects who are negative for all testing will be considered naïve to SARS-CoV-2 infection. In the unlikely case that a subject tests positive by the rapid antigen test but negative by RT-PCR, the subject will still be considered naïve without a positive virological confirmation by RT-PCR (unless determined otherwise by a seropositive test to the N protein).

9.5.2 Confirmation of a Positive Test for SARS-CoV-2 Infection Performed Outside of the Site See Section 9.2.1.1.2 and Section 9.2.2 for follow-up of subjects who report a positive test for SARS-CoV-2 infection performed outside of the site.

For subjects (symptomatic or asymptomatic) who report a positive test for SARS-CoV-2 infection which was performed outside of the site, regardless of the type of test, the subject should be retested as soon as feasible to confirm the result. A nasopharyngeal swab sample should be sent to the central laboratory for RT-PCR testing for confirmation. The retest result at the central laboratory will be considered definitive.

10 Statistical Considerations 10.1 Sample Size Determination 10.1.1 Primary Efficacy Co-Objectives This is an event-driven trial. Sample size and power considerations are based on the co primary objectives for demonstrating efficacy of CVnCoV in the prevention of virologically confirmed cases of COVID-19 of any severity or COVID-19 cases of moderate or higher severity meeting the co-primary case definitions. A group sequential design with 2 interim analyses for cases of COVID-19 of any severity demonstrating a high level of efficacy or reaching futility is planned using O'Brien and Fleming type error spending-function (Lan et al. 1983) and the sample size is based on the test for one single proportion (i.e. the proportion of cases in the CVnCoV group, among all cases). The group sequential design is based on the any severity COVID-19 endpoint, due to the higher case number required to meet this endpoint.

To control the type one error for the 2 co-primary objectives, the overall 2-sided alpha of 5% has been equally split between the 2 co-primary objectives. With an overall 2-sided alpha of 2.5%, a total of 185 COVID-19 cases of any severity (meeting the co-primary efficacy case definition for COVID-19 of any severity) are needed at final analysis, to have a power of 90% to demonstrate the VE is above 30% based on the lower bound of the CI for VE, when considering the VE under the alternative hypothesis is 60% (i.e.

equivalently to demonstrate the proportion of cases in the CVnCoV group is below 0.4118, based on the upper bound of the CI for proportion when considering the proportion under the alternative hypothesis is equal to 0.2857).

With an overall 2-sided alpha of 2.5%, a total of 60 moderate to severe cases of COVID-19 (meeting the co-primary efficacy case definition of moderate or severe COVID-19) are needed at the final analysis, to have a power of 90% to demonstrate the VE is above 20% based on the lower bound of the CI for VE when considering the VE under the alternative hypothesis is 70% (i.e. equivalently to demonstrate the proportion of cases in the CVnCoV group is below 0.4444, based on the upper bound of the CI for proportion when considering the proportion under the alternative hypothesis is equal to 0.2308). If ⅓ of COVID-19 cases of any severity are moderate to severe, then 60 moderate to severe cases will be obtained when the total number of COVID-19 cases is 180. There is no interim analysis planned for this endpoint.

The two interim analyses for high efficacy or futility of the co-primary objective of COVID 19 cases of any severity will be performed once 56/111 cases have been accrued (approximately 30%/60% of cases).

Assuming an incidence rate of COVID-19 of 0.15% per month in placebo subjects, an overall non-evaluable rate of 20% (corresponding to subjects excluded from the EAS and drop-outs) and a VE of 60%, 36,500 subjects enrolled over approximately 3 months (18,250 per vaccine group) will accrue 185 COVID-19 cases of any severity at approximately 9 months after the first vaccination. A lower incidence rate, a longer enrollment duration, or a higher non evaluable rate or VE will delay the acquisition of the 185 cases and the time of final analysis. Subjects will be randomized to receive either CVnCoV or placebo in a 1:1 ratio, stratified by country and age group (18 to 60 and ≥61 years of age).

10.1.2 Key Secondary Efficacy Objectives

For the key secondary efficacy objective evaluating the prevention of virologically confirmed severe cases of COVID-19, a lower number of cases will be collected at the time of final analysis compared to the primary endpoint. Based on an analysis of a large database by Verity et al. 2019, approximately 20% of COVID-19 cases can be clinically defined as severe or critical, the latter requiring intensive care.

With 37 cases of severe COVID-19 (20% of 185 cases), the trial will have 88% power to detect a lower limit of the 95% CI of the VE above 10% when assuming the VE is 70%. The power increases to 90% if the VE against severe cases is 75%. With complete follow up of all evaluable subjects for 1 year in the HERALD Trial CV-NCOV-004, it is expected that the additional number of COVID-19 cases accrued post-second vaccination would permit a more robust evaluation of CVnCoV efficacy against severe disease. This analysis will be presented in the SAP.

For the next key secondary efficacy objective, assuming that 45% of SARS-COV-2 infections are asymptomatic (Daniel et al. 2020), approximately 300 asymptomatic infections are expected after 1 complete year of follow-up post-second vaccination for all evaluable subjects. With this number of cases, the trial will have 80% power to detect a lower limit of the 95% CI of the VE above 0% when assuming the VE against asymptomatic infections is 28%.

10.2 Populations for Analyses

In the Safety Analysis Set (SAS), Safety Analysis Set 2 (SAS 2), and the Solicited AEs Safety Analysis Set (SAS-sol), subjects will be analyzed in the group they actually received (as "treated").

Following the "intent to treat" principle in the Efficacy sets and Per-Protocol Sets, subjects will be analyzed in the group to which they were randomized (as "randomized").

10.2.1 Safety Analysis Set (SAS)

The SAS will include all subjects randomized in Phase 2b or 3 who received at least one dose of CVnCoV or placebo.

The SAS will be the primary population for safety endpoints collected on all subjects (i.e. medically-attended AEs, AESI, AEs leading to withdrawal or trial discontinuation and SAEs) and for efficacy objectives assessing efficacy after the first dose.

10.2.2 Safety Analysis Sets 2 (SAS 2, SASsol)

As solicited and unsolicited AEs are collected only for Phase 2b subjects, these analyses will then be restricted to the Phase 2b subjects.

The SAS 2 population will include all Phase 2b subjects of the SAS and will be used for unsolicited AEs analysis.

The SASsol population will include all Phase 2b subjects of the SAS with at least one diary collection indicating the occurrence or lack of occurrence of solicited AEs and will be used for solicited AEs analysis.

10.2.3 Efficacy Analysis Set (EAS)

The EAS will include all subjects randomized in Phase 2b or Phase 3 who:

Received both doses of trial vaccine according to their randomization (2 doses of CVnCoV or 2 doses of placebo).

Had not developed a virologically-confirmed case of COVID-19 before trial entry (based on exclusion criteria 1) or before 15 days following the second vaccination.

Had not stopped the trial before 15 days following the second vaccination.

Were SARS-CoV-2 naïve at baseline (based on seronegativity to N protein in the blood sample taken at baseline).

The EAS will be the primary analysis population for all efficacy endpoints (except for the key secondary efficacy endpoint related to seroconversion and for the efficacy endpoints evaluating efficacy starting after the first dose).

10.2.4 Efficacy Analysis Set for Seroconversion (EASS)

The EASS population will include all subjects of the EAS who tested seronegative at baseline and Day 43 for the N protein of SARS-CoV-2 (i.e. at all the testing time points before 15 days following the second vaccination) and for whom at least one serological test result for N protein at ≥15 days following the second vaccination (Day 211 or 393) is available for analysis.

The primary analysis of the key secondary efficacy endpoint related to seroconversion to the N protein of SARS-CoV-2 (asymptomatic infections) will be performed on this population.

10.2.5 Per Protocol Efficacy Set (PPE)

The Per Protocol Efficacy set will include EAS subjects who meet all eligibility criteria at trial entry and who have no major protocol deviations that would impact the efficacy outcomes as specified in the SAP.

The PPE will be a supportive population for efficacy endpoints (except for the key secondary efficacy endpoint related to seroconversion and for the efficacy secondary endpoint evaluating efficacy starting after the first dose).

10.2.6 Per Protocol Immunogenicity Set (PPI)

The PPI set will include all Phase 2b subjects who belong to the Immunogenicity Subset (IS) {i.e. ~first 600 subjects enrolled into each of the 2 age groups in Phase 2b (18-60 and ≥61 years of age)} and who:

- Received both doses as randomized and within the windows defined in the protocol.
- Have no major protocol deviations expecting to impact the immunogenicity outcomes as specified in the SAP.
- Have not received medical treatments (such as blood products, immunoglobulin therapy) that may interfere with one or both of the proposed immunogenicity measurements.
- Have at least one blood sample collected starting at 14 days (Day 43) post-second vaccination available for analysis.

The PPI will be the primary analysis population for SARS-CoV-2 RBD of S protein antibody responses and SARS-CoV-2 viral neutralizing antibody.

Subjects to be excluded from the PPE/PPI will be identified and reviewed at the Blinded Data Review Meeting held before unblinding of the trial. Major protocol deviations will be listed and summarized.

Table 18 provides a summary of primary and supportive populations planned for analysis of each endpoint. Other analysis populations may be defined in the SAP.

10.3 Statistical Analyses 10.3.1 General Considerations

Five analyses are planned: 2 interim (when 56/111 cases are reached); the final (when 185 cases are reached); the 1 year follow-up (on all data up to Day 393 visit); and the 2 year follow-up (on all data up to end of Extension Study). An SAP for the interim and final analyses will be prepared and finalized at the latest prior to database locks. This document will provide further details regarding the definition of analysis variables and analysis methodology to address all trial objectives and the handling of missing data. All analyses planned for the final analysis will be regenerated for the 1 year follow-up and 2 year follow up analyses.

10.3.2 Demographic, Medical History, and Other Baseline Characteristics

Data will be summarized with respect to demographic and baseline characteristics (e.g. age, gender, height, weight), medical history, baseline immune status, and all safety measurements using descriptive statistics (quantitative data) and contingency tables (qualitative data) overall, by vaccine group, and by age group and vaccine group.

10.3.3 Trial Vaccine Administration

The administrations of CVnCoV or control will be listed and the number of subjects actually receiving the vaccination doses will be summarized by vaccine group.

TABLE 18

Primary and Supportive Populations for the Analysis of Each Endpoint

| Endpoints | Primary Population | Supportive Population |
|---|---|---|
| Primary Efficacy Endpoints | EAS | PPE |
| Primary Safety Endpoints | | |
| SAEs, AESI, medically-attended AEs | SAS | — |
| Secondary Efficacy Endpoints: | | |
| Severe COVID-19 | EAS | PPE |
| Asymptomatic infections (Seroconversion to the N protein) | EASS | |
| COVID-19 in ≥ 61 years of age | EAS (≥61 years of age subjects) | PPE (≥61 years of age subjects) |
| All SARS-CoV-2 infection (RT-PCR positive) | EAS | PPE |
| COVID-19 after first dose | SAS (naïve subjects) | — |
| Secondary Immunogenicity Endpoints: | | |
| SARS-CoV-2 RBD of spike (S) protein antibody responses | PPI | — |
| SARS-CoV-2 viral neutralizing antibody | PPI | — |
| Safety Endpoints: | | |
| Solicited AEs | SASsol | — |
| Unsolicited AEs | SAS 2 | — |
| AE leading to vaccine withdrawal | SAS | — |
| Exploratory Efficacy Endpoints: | | |
| Severity of COVID-19 | EAS | — |
| Supplemental oxygenation, hospitalization, mechanical ventilation, death | EAS | SAS |
| COVID-19 after first dose | SAS | — |
| Second episode of COVID-19 | EAS | — |
| Exploratory Immunogenicity Endpoints: | | |
| RBD of S-specific T-cell response after antigen stimulation by intracellular cytokine staining (ICS) to investigate Th1 response and expression of Th2 | PPI | — |
| The proportion of subjects with a detectable increase in SARS-CoV-2 RBD of S-specific T-cell response | PPI | — |

10.3.4 Concomitant Medication and Vaccinations

Concomitant medication/vaccination after the start of the trial will be listed and summarized by Anatomical Therapeutic Chemical term, overall and by vaccine group.

10.3.5 Efficacy Analyses 10.3.5.1 Co-Primary Efficacy Endpoint Analysis

Primary Efficacy Analysis

In primary efficacy analysis, the VE, defined as the percent reduction in the frequency of any and moderate to severe COVID-19 cases (according to primary case definitions) in vaccinated subjects compared with subjects who received placebo will be calculated with exact 95%* CI as follows:

$$VE=1-RR=1-(ARV/ARP)=1-\{p/r(1-p)\}$$

where

ARV=attack rate in vaccinated group=nv/Nv=number of subjects reporting at least one COVID-19 episode in the CVnCoV group/total follow-up time of evaluable subjects in the CVnCoV group (number of person-month).

ARP=attack rate in placebo group=np/Np=number of subjects reporting at least one COVID-19 episode in the placebo group/total follow-up time of evaluable subjects in the placebo group (number of person-month).

RR=relative risk=ARV/ARP p=proportion of COVID-19 cases (according to primary case definition) coming from the CVnCoV group among all cases=nv/(nv+np).

r=ratio of total follow-up time of evaluable subjects in the CVnCoV group over total follow-up time of evaluable subjects in the placebo group=Nv/Np.

*Level of CI may be slightly adjusted due to the sequential design (see Section 10.3.8).

The statistical hypotheses for the co-primary efficacy endpoints are:

H0A: VE≤30% versus H1A: VE>30% and
H0S: VE≤20% versus H1S: VE>20%
A is related to COVID-19 cases of any severity;
S is related to moderate to severe cases of COVID-19;

The trial will be successful if either the lower limit (LL) of the exact 2-sided 97.5% (to be slightly adjusted to consider the sequential design) CI of VE endpoint is >30% for all COVID-19 cases of any severity or if the lower limit (LL) of the exact 2-sided 97.5% CI of VE endpoint is >20% for severe to moderate COVID-19 cases.

If the 2 interim analyses and the final analysis for COVID-19 cases of any severity are performed after 56/111 and 185 cases have been reported, respectively, the 1-sided α-risk to consider at the time of final analysis according to O'Brien Fleming type error spending function will be 0.01209 and efficacy will be demonstrated at the final analysis if 60 cases or less over 185 are in the CVnCoV group (observed VE≥52.0%); and 0.025 for the final analysis for cases of moderate to severe COVID-19 and efficacy will be demonstrated if 17 cases or less over 60 are in the CVnCoV group (observed VE≥60.5%). To note, the rule in terms of split of cases to demonstrate efficacy can slightly differ if r≠1 (total follow-up time different in both groups).

Sensitivity Analysis

As a key sensitivity analysis, the time to first-occurrence of virologically-confirmed COVID 19 cases (according to primary case definitions) will be analyzed.

The Kaplan-Meier curves will display the estimated probabilities of not developing COVID 19 and log-rank test will be performed.

The time to first-occurrence of virologically-confirmed COVID-19 (date of symptoms onset) will start 15 days following the second vaccination.

Subjects who do not develop COVID-19 will be censored at the date of trial termination or cut-off date for analysis whichever comes first.

An additional sensitivity analysis may include a Cox proportional hazards regression model adjusted for relevant baseline covariates specified in the SAP.

More details on the analysis methods will be described in the SAP.

10.3.5.2 Secondary Efficacy Endpoints Analyses

Statistical testing of the 2 key secondary efficacy endpoints will be performed according to the conditional hierarchical testing procedure using the order defined in the objective/endpoints sections. Consequently:

Efficacy of CVnCoV in regard to severe cases will be demonstrated only if there is successful demonstration of the primary efficacy objective.

Efficacy of CVnCoV in regard to asymptomatic infection will be demonstrated only if there is successful demonstration of the primary efficacy objective and secondary objective on severe cases.

Otherwise, these endpoints will be analyzed as exploratory endpoints without success criteria testing.

To assess the efficacy in the prevention of severe disease and asymptomatic infections, similar analyses to those performed on the primary efficacy endpoint will be performed. The efficacy will be demonstrated if the LL of the exact 2-sided 95% CI of VE is above 10% for severe disease and above 0% for asymptomatic infections.

Other secondary efficacy endpoints will be analyzed similarly to the primary efficacy endpoint but no formal testing will be performed for those endpoints. For efficacy after the first dose, the time to first-occurrence of virologically-confirmed COVID-19 (date of symptom onset) will start after the first vaccination. The BoD will be analyzed using 2 different scoring systems. Both BoD scoring systems place more weight on efficacy against severe COVID-19 disease or severe disease as reflected by hospitalization or death. In addition, VE and associated CI will be calculated for each of the BoD categories.

10.3.5.3 Exploratory Efficacy Endpoints Analyses

The proportions of mild and severe COVID-19 cases (according to primary case definition) among all cases will be summarized by group.

Description of frequencies and percentages will be provided by group for subjects who:

Need supplemental oxygenation due to COVID-19.
Need mechanical ventilation due to COVID-19.
Are hospitalized due to COVID-19.
Died due to COVID-19.
Died due to any cause.

This will be done for events occurring≥15 days following the second trial vaccination (full VE) and then for events occurring at any time after the first trial vaccination.

The VE in the prevention of first episodes of virologically-confirmed cases of COVID-19 of any severity will be reassessed on all subjects whatever their serological status at baseline for cases occurring≥15 days following the second trial vaccination and then for all cases occurring after the first dose.

Finally, the number and percentage of subjects who developed a second episode of COVID-19 will be displayed by group.

10.3.6 Secondary and Exploratory Immunogenicity Analysis

No formal hypothesis on immunogenicity will be tested. Descriptive statistics for the immunogenicity endpoints will be provided for each vaccine group and overall, and by vaccine group and age groups. Data will be presented after each vaccine dose.

The following analyses will be performed for antibody levels to the SARS-CoV-2 RBD of S protein and for neutralizing antibodies overall and separately in subjects seronegative at baseline and in subjects seropositive at baseline:

Geometric mean titers (GMTs) will be summarized with their 95% CI at each blood sampling time point.

The Fold Change (FC) from baseline will be computed for each subject and Geometric mean of FC (GMFC) will be displayed with their 95% CI at each blood sampling time point after baseline.

Non detectable antibodies will be arbitrary replaced by half of the detection cut-off for GMT and GMFC computations purpose.

For each readout, the number and percentage of subjects SARS CoV-2 seronegative at baseline for who a seroconversion is observed will be summarized and presented at each blood sampling time point after baseline with exact 95% CI. Seroconversion is defined as detectable antibodies in the serum.

Percentages of subjects seroconverting for SARS CoV-2 RBD of S protein antibodies and SARS CoV-2 neutralizing antibodies will be summarized. The frequency of immune-cell populations induced by the vaccine will be summarized. Further characterization of the T cell immune response may be done with other technologies like ELISpot, CyTOF and/or analysis of genomic biomarkers.

Additional immunogenicity analyses including graphs will be described in the SAP as applicable.

10.3.7 Safety Analysis

No formal statistical testing of safety data is planned.

The descriptive safety analyses will be performed overall, by vaccine group and by age group and vaccine group. The following analyses will be done overall and separately in subjects seronegative at baseline and in subjects seropositive at baseline for SARS-CoV-2 N protein antibody levels:

Solicited AEs: The frequencies and percentages of subjects experiencing each solicited local and systemic AE within 7 days after each vaccination will be presented by intensity and overall. For subjects with more than 1 episode of the same AE within 7 days after a vaccination, the maximum intensity will be used for tabulations. Similar tabulations will be performed for solicited systemic AEs by relationship to trial vaccination. Solicited local AEs will be by definition considered as related to the trial vaccine. Time to onset (in days) and duration (in days) will also be summarized for each solicited local and systemic AEs. Summary tables showing the occurrence of at least one local or systemic solicited AE within 7 days after each vaccination will also be presented.

Unsolicited AEs: Unsolicited AEs including SAEs and AESIs will be coded using the Medical Dictionary for Regulatory Activities (MedDRA) by System Organ Class (SOC) and Preferred Term (PT).

The frequency and percentage of subjects reporting each unsolicited AE within the 28 days after each vaccination and overall will be tabulated at the SOC and PT levels.

Similar tables will be provided for: related unsolicited AEs, Grade 3 or higher unsolicited AEs, medically-attended AEs that occur within 6 months after the second trial vaccination, SAEs, related SAEs, AESIs, related AESIs, AEs leading to withdrawal or trial discontinuation and SAEs resulting in death through 1 year after the second trial vaccination. When an AE occurs more than once for a subject within the 28 days post 1 vaccination, the maximal severity and strongest relationship to the vaccine group will be counted.

Only AE post first vaccination will be considered in the summary tables. AE starting prior to the first vaccination will be recorded as medical history.

Data listings of fatal and SAEs will be provided by subject.

Vital signs will be summarized by descriptive statistics at each visit, including change from baseline, and a listing will be provided.

10.3.8 Interim Analysis

Two interim analyses will be performed for this trial by an unblinded independent statistician and reviewed by the DSMB when 56/111 cases of COVID-19 of any severity (meeting the co-primary efficacy case definition) are observed. This analysis will aim to assess early high efficacy or futility on the primary efficacy endpoint and will be done on the EAS population only. The safety data that is available at this time point will also be described.

For the analysis of early demonstration of high efficacy or futility, cumulative O'Brien Fleming type error spending function (Lan et al. 1983) is used to provide statistical stopping rules for high efficacy ($\alpha$-boundaries) and futility ($\beta$-boundaries) for the interim analysis, based on the information accumulated until that specific interim stage.

At the interim stage, if the p-value for the test of the primary objective is lower than the a boundary, a high level of efficacy for CVnCoV will be declared. Conversely, demonstration of futility will occur if the p-value is higher than the $\beta$-boundary.

The interim analyses are planned to occur when 56/11 cases of COVID-19 of any severity have been observed.

Table 19 below shows the boundaries for demonstrating high efficacy or futility, calculated on a 1 sided p-value scale using the cumulative error spending function.

TABLE 19

Two Stage Group Sequential Design with Interim Analyses at 56 and 111 Cases and Final Analysis at 185 Cases

|  | Interim Analysis 1 | Interim Analysis 2 | Final Analysis |
|---|---|---|---|
| Number of Cases | 56 | 111 | 185 |
| Efficacy $\alpha$-Boundary on p-value scale (1-sided) | 0.00001 | 0.00126 | 0.01209 |
| Futility $\beta$-Boundary on p-value scale (1-sided) | 0.73596 | 0.15716 | NA |

TABLE 19-continued

Two Stage Group Sequential Design with Interim Analyses
at 56 and 111 Cases and Final Analysis at 185 Cases

|  | Interim Analysis 1 | Interim Analysis 2 | Final Analysis |
|---|---|---|---|
| Efficacy success criteria* | Success if ≤ 7 cases in CVnCoV group over 56 cases (observed VE ≥ 85.7%) | Success if ≤ 29 cases in CVnCoV group over 111 cases (observed VE ≥ 64.6%) | Success if ≤ 60 cases in CVnCoV group over 185 cases (observed VE ≥ 52.0%) |
| Futility* | Futility if ≥ 26 cases in CVnCoV group over 56 cases (observed VE ≤ 13.3%) | Futility if ≥ 41 cases in CVnCoV group over 111 cases (observed VE ≤ 41.4%) | NA |

*Rules in terms of split of cases to demonstrate efficacy/futility can slightly differ if the total number of evaluable subjects is unequal in both groups (r ≠ 1).

If the interim analysis is performed exactly after 56/111 cases have been reported, a 1 sided p-value lower than 0.00001/0.00126 (i.e. lower limit of the 2-sided 99.99%/99.99% CI>30%) will lead to the conclusion of high efficacy, while a 1-sided p-value higher than 0.73596/0.15716 will result in the demonstration of futility. Otherwise, the final analysis will be performed at 185 cases. Similarly, if the number of evaluable subjects is equal in both groups, it means that the trial will conclude early high efficacy if 7/29 cases or less over 56/111 are coming from the CVnCoV group, while futility of the trial will be demonstrated if 26/41 cases or more are coming from the CVnCoV group.

Of note, the actual boundaries used for decision making would depend on the exact number of cases occurring and reported at each analysis (interim and final).

The boundaries will be applied in a nonbinding way as there are many other factors that would be part of the decision-making process.

10.3.9 Missing Data and Discontinuation

Analysis of vaccination variables will be done on a valid case basis, i.e., for missing observations, no imputation for missing data, such as last observation carried forward, will be applied.

For SARS-CoV-2 RBD of S protein antibodies, concentration values marked as below the lower limit of quantification (LLOQ) will be set to 0.5*LLOQ.

No imputation of missing values will be done for any analysis (except the imputation for missing partial dates of AEs and concomitant medication as specified in the SAP).

Currently no replacement of drop-out subjects is foreseen.

Example 14: Vaccination of Rats with mRNA Encoding SARS-CoV-2 Antigen S_Stab Formulated in LNPs The present example shows that SARS-CoV-2 S mRNA vaccines with mRNA comprising alternative forms of the 3' end (A64-N5-C30-hSL-N5 or hSL-A100) and UTR combinations (i-3 (—/muag) or a-1 (HSD17B4/PSMB3)) induce strong humoral as well as cellular immune response in rats. mRNA encoding SARS-CoV-2 S_stab comprising hSL-A100 and the UTR combination a-1 (HSD17B4/PSMB3) shows stronger and very early induction of immune responses, demonstrated by a stronger induction of binding and neutralizing antibodies even after one first vaccination.

Preparation of LNP Formulated mRNA Vaccine:

SARS-CoV-2 S mRNA constructs are prepared as described in Example 1 (RNA in vitro transcription). HPLC purified mRNA was formulated with LNPs according to Example 1.4 prior to use in in vivo vaccination experiments.

Immunization:

Rats were injected intramuscularly (i.m.) with mRNA vaccine compositions and doses as indicated in Table 18. As a negative control, one group of rats was vaccinated with buffer (group A). All animals were vaccinated on day 0 and day 21. Blood samples were collected on day 14, day 21 (post prime) and 42 (post boost) for the determination of antibody titers.

TABLE 20

Vaccination regimen (Example 14):

| Group | Vaccine composition | mRNA ID | CDS opt. | 5'-UTR/3'-UTR; UTR Design | 3'-end | SEQ ID NO: Protein | SEQ ID NO: RNA | Dose |
|---|---|---|---|---|---|---|---|---|
| A | buffer | — | — | — | — | — | — | — |
|  | mRNA encoding S_stab formulated in LNPs | R9515 | opt1 | —/muag; | A64-N5-C30-hSL-N5 | 10 | 163 | 0.5 μg |
| B | mRNA encoding S_stab formulated in LNPs | R9515 | opt1 | —/muag; | A64-N5-C30-hSL-N5 | 10 | 163 | 2 μg |
| C | mRNA encoding S_stab formulated in LNPs | R9515 | opt1 | —/muag; | A64-N5-C30-hSL-N5 | 10 | 163 | 8 μg |
| D | mRNA encoding S_stab formulated in LNPs | R9515 | opt1 | —/muag; | A64-N5-C30-hSL-N5 | 10 | 163 | 20 μg |
| E | mRNA encoding S_stab formulated in LNPs | R9515 | opt1 | —/muag; | A64-N5-C30-hSL-N5 | 10 | 163 | 40 μg |
| F | mRNA encoding S_stab formulated in LNPs | R9709 | opt1 | HSD17B4/PSMB3 | hSL-A100 | 10 | 149 | 0.5 μg |

TABLE 20-continued

Vaccination regimen (Example 14):

| Group | Vaccine composition | mRNA ID | CDS opt. | 5'-UTR/3'-UTR; UTR Design | 3'-end | SEQ ID NO: Protein | SEQ ID NO: RNA | Dose |
|---|---|---|---|---|---|---|---|---|
| G | mRNA encoding S_stab formulated in LNPs | R9709 | opt1 | HSD17B4/PSMB3 | hSL-A100 | 10 | 149 | 2 µg |
| H | mRNA encoding S_stab formulated in LNPs | R9709 | opt1 | HSD17B4/PSMB3 | hSL-A100 | 10 | 149 | 8 µg |
| I | mRNA encoding S_stab formulated in LNPs | R9709 | opt1 | HSD17B4/PSMB3 | hSL-A100 | 10 | 149 | 20 µg |
| J | mRNA encoding S_stab formulated in LNPs | R9709 | opt1 | HSD17B4/PSMB3 | hSL-A100 | 10 | 149 | 40 µg |

Determination of IgG1 and IgG2 Antibody Titers Using ELISA:

ELISA was performed as described before in Example 12.

Determination of Virus Neutralizing Antibody Titers (VNT)

Virus neutralizing antibody titers (VNT) of rat serum samples were analyzed as previously described in Example 6 with mouse serum.

Results:

As shown in FIG. 16A the vaccination with mRNA full length S stabilized protein comprising the non-coding region with 3' end hSL-A100 and the UTR combination a-1 (HSD17B4/PSMB3) formulated in LNPs (R9709) induced in rats robust and dose dependent levels of binding antibody titers (shown by IgG1 and IgG2a endpoint titers) at day 14 and day 21 already after one first vaccination using doses of 0.5 µg, 2 µg, 8 µg, 20 µg, and 40 µg. The vaccination with mRNA full length S stabilized protein comprising the non-coding region with 3' end A64-N5-C30-hSL-N5 and the UTR combination i-3 (−/muag) formulated in LNPs (R9515, CVnCov) induced in rats dose dependent levels of binding antibody titers (shown by IgG1 and IgG2a endpoint titers) at day 14 and day 21 already after one first vaccination using the higher doses (8 µg, 20 µg, and 40 µg).

As shown in FIG. 16B vaccination with mRNA comprising the non-coding region with 3' end hSL-A100 and the UTR combination a-1 (HSD17B4/PSMB3) encoding full length S stabilized protein formulated in LNPs (R9709) induced in rats dose dependent and very high levels of VNT, already after 14 days after one first vaccination with a dose of at least 2 µg.

As shown in FIG. 16C vaccination with both mRNA vaccine formats encoding full length S stabilized protein formulated in LNPs induce strong VNTs in a dose dependent manner. The induction of VNTs with mRNA encoding SARS-CoV-2 S_stab comprising hSL-A100 and the UTR combination a-1 (HSD17B4/PSMB3) shows a stronger and very robust induction of very high neutralizing antibody titers even at a dose of only 2 µg, when compared with mRNA encoding SARS-CoV-2 S_stab comprising A64-N5-C30-hSL-N5 and the UTR combination i-3 (−/muag). The titer of neutralizing antibodies raised by the vaccine composition comprising mRNA R9709 could be further notably increased by the second vaccination.

The strength of vaccine composition comprising R9709 may support an immunization protocol for the treatment or prophylaxis of a subject against coronavirus, preferably SARS-CoV-2 coronavirus comprising only one single dose of the composition or the vaccine.

Example 15: Vaccination of NHP with mRNA Encoding SARS-CoV-2 Antigen S_Stab Formulated in LNPs and Challenge The protective efficacy of mRNA encoding S_stab formulated in LNPs (CVnCoV) was addressed in a rhesus macaque SARS-CoV-2 challenge model. Non-human primates develop mild clinical disease with high levels of viral replication in both the upper and lower respiratory tract and pathological changes indicative of viral pneumonia upon infection with SARS-CoV-2 (Munoz-Fontela et al., 2020). Results presented that CVnCoV had protective impact against challenge with $5 \times 10^6$ PFU via the intra nasal (IN) and intra tracheal (IT) routes in an NHP in vivo model of COVID-19. Protective endpoints include significantly reduced virus load, in addition to protection against lung pathology.

Preparation of LNP Formulated mRNA Vaccine:

SARS-CoV-2 S mRNA construct was prepared as described in Example 1 (RNA in vitro transcription). HPLC purified mRNA was formulated with LNPs according to Example 1.4 prior to use in in vivo vaccination experiments.

Immunization and Challenge:

Eighteen rhesus macaques (*Macaca* mulatta), of Indian origin were divided into three groups of six, each comprising three males and three females (with a weight of >4.5 kg and an age of 3-6 years). Animals were vaccinated twice with either 0.5 µg or 8 µg LNP-formulated mRNA encoding SARS-CoV-2 antigen S_stab (SARS-CoV-2 S-2P (CVnCoV)) or remained unvaccinated prior to challenge with wild type SARS-CoV-2 four weeks after the second vaccination (see FIG. 17A). The animals were injected intramuscularly (i.m.) in the bicep muscle of the upper arm with mRNA vaccine compositions, in a volume of 0.5 ml and doses as indicated in Table 21. As negative control, one group of NHPs was not treated/unvaccinated before challenge (group A). Blood samples were collected on day 0, 14, 28 (post first vaccination), on day 42 and 56 (post second vaccination), and on day 1, 3, 5, 7 after challenge for the determination of antibody titers. The animals were intranasally challenged on day 56 with a dose of $5.0 \times 10^6$ PFU SARS-CoV-2 by applying 2 ml of virus preparation to the pre-carinal section of the trachea using a bronchoscope followed by 1 ml applied intranasally (0.5 ml/nostril). Two animals of each group were followed for 6, 7 or 8 days post challenge (p.c.) and euthanised on day 62, 63 or 63 of the experiment.

TABLE 21

Vaccination regimen (Example 15):

| Group | Vaccine composition | mRNA ID | dose | vaccination | CDS opt. | SEQ ID NO: Protein | SEQ ID NO: RNA |
|---|---|---|---|---|---|---|---|
| A | mRNA encoding S_stab formulated in LNPs (CVnCoV) | R9515 | 0.5 µg | d 0, d 28 | opt1 | 10 | 163 |
| B | mRNA encoding S_stab formulated in LNPs (CVnCoV) | R9515 | 8 µg | d 0, d 28 | opt1 | 10 | 163 |
| C | Unvaccinated | | | | | | |

IgG ELISA

A full-length trimeric and stabilised version of the SARS-CoV-2 Spike protein was supplied by Lake Pharma (#46328). Recombinant SARS-CoV-2 Receptor-Binding-Domain (319-541) Myc-His was developed and kindly provided by MassBiologics. Recombinant SARS-CoV-2 Spike- and RBD-specific IgG responses were determined by ELISA. High-binding 96-well plates (Nunc Maxisorp, 442404) were coated with 50 µl per well of 2 µg/ml Spike trimer or Spike RBD in 1×PBS (Gibco) and incubated overnight at 40C. The ELISA plates were washed and blocked with 5% Foetal Bovine Serum (FBS, Sigma, F9665) in 1×PBS/0.1% Tween 20 for 1 hour at room temperature. Serum collected from animals after vaccination had a starting dilution of 1/50 followed by 8, two-fold serial dilutions. Post-challenge samples were inactivated in 0.5% triton and had a starting dilution of 1/100 followed by 8, three-fold serial dilutions. Serial dilutions were performed in 10% FBS in 1×PBS/0.1% Tween 20. After washing the plates, 50 µl/well of each serum dilution was added to the antigen-coated plate in duplicate and incubated for 2 hours at room temperature. Following washing, anti-monkey IgG conjugated to HRP (Invitrogen, PA1-84631) was diluted (1:10, 000) in 10% FBS in 1×PBS/0.1% Tween 20 and 100 µl/well was added to the plate. Plates were then incubated for 1 hour at room temperature. After washing, 1 mg/ml O-Phenylenediamine dihydrochloride solution (Sigma P9187) was prepared and 100 µl per well were added. The development was stopped with 50 µl per well 1M Hydrochloric acid (Fisher Chemical, J/4320/15) and the absorbance at 490 nm was read on a Molecular Devices versamax plate reader using Softmax (version 7.0). All test sample dose response curves were fitted to a 4PL model in Softmax Pro (version 7.0) and the endpoint titre at an OD of 0.5 (defined as reciprocal of the serum dilution required to give an absorbance response of 0.5) was interpolated from each curve. Where results were below the limit of detection, they were assigned a value of 25 for the post immunisation samples and 50 for the post challenge samples. For low samples where the absorbance never reached a value of 0.5, the titre was estimated from the extrapolated portion of the curve. The cut-off was set as the average titre of serum collected from naïve animals (day 0)+1 Standard Deviation. The cut off was calculated separately for each antigen.

SARS-CoV-2 Focus Reduction Neutralisation Test

Virus neutralising titres were measured in heat-inactivated serum samples (56° C. for 30 min). SARS-CoV-2 (Victoria/01/2020, Doherty Institute) at a concentration to give 100 to 250 foci per well in the virus only control wells was mixed 50:50 in 1% FCS MEM with 1× antibiotic/antimycotic (Gibco, 15240-062) with serum doubling dilutions from 1:20 to 1:640 (or higher dependent on antibody levels) in a 96-well V-bottomed plate. The plate was incubated at 370C in a humidified box for 1 hour to allow antibodies in the serum sample to bind to the virus. One hundred microlitres of the serum/virus mixture was then transferred to virus susceptible Vero/E6 monolayers in 96-well plates and incubated for a further 1 hour at 370C in a sealed humidified box. After adsorption, the virus/antibody mixture was removed and 100 µl of 1% w/v CMC in complete media overlay was added. The box was resealed and incubated at 370C for 24 hours prior to fixing with 100 µl of 20% formalin/PBS solution and fumigation of the plate overnight prior to immunostaining. Following washing with water using an ELISA washer (BioTek 405 TSUS), residual endogenous peroxidase activity was removed by the addition of 0.3% hydrogen peroxide for 20 min. Plates were then incubated for 1 h with primary/detection SARS-CoV-2 anti-RBD rabbit polyclonal antibody (SinoBiologicals; 40592-T62) diluted 1:2,000 in PBS. After washing, plates were incubated for 1 h with secondary anti-rabbit HRP-conjugate antibody (Invitrogen; G-21234) diluted 1:4,000 in PBS. After washing, foci were visualised using TrueBlue™ Peroxidase Substrate (KPL seracare; 5510-0030) after which plates were washed with water and dried. Foci were counted using an ImmunoSpot S6 Ultra-V analyser (CTL) and BioSpot software (7.0.28.4 Professional; CTL) and the results analysed in SoftMax Pro (Molecular Devices; v7.0.3 GxP). Briefly, the count data was expressed as percentage of VOC for each serum dilution, i.e. percentage foci reduction and plotted on a 4-Parameter logistic (4PL) curve. The virus neutralisation titre (VNT) is reported as serum dilution that neutralised 50% of the virus foci.

Alternatively virus neutralizing titres were measured as previously described in Example 9 with a SARS-CoV-2 virus featuring the mutation D614G.

ELISpot

Peripheral Blood Mononuclear Cells (PBMCs) were isolated from whole heparinised blood by density gradient centrifugation using Ficoll-Paque Plus (GE Healthcare, USA). An IFN-γ ELISpot assay was used to estimate the frequency and IFN-γ production capacity of SARS-CoV-2-specific T cells in PBMCs using a human/simian IFN-γ kit (MabTech, Nacka, Sweden). The cells were assayed at $2 \times 10^5$ cells per well. Cells were stimulated overnight with SARS-CoV-2 peptide pools and 'megapools' of the spike protein (Mimotopes, Australia). Peptide sequence was based on GenBank: MN908947.3. Ten peptide pools were used, comprising of 15 mer peptides, overlapping by 11 amino acids. The three megapools were made up as such: Megapool 1 (MP1) comprised peptide pools 1-3, Megapool 2 (MP2) comprised peptide pools 4-6 and Megapool 3 (MP3) comprised of peptide pools 7-10. All peptides were used at a final concentration of 1.7 µg/ml per peptide. Phorbol 12-myristate (Sigma-Aldrich Dorset, UK) (100 ng/ml) and ionomycin (CN Biosciences, Nottingham, UK) (1 mg/ml)

were used as a positive control. Results were calculated to report as spot forming units (SFU) per million cells. All SARS-CoV-2 peptides and megapools were assayed in duplicate and media only wells subtracted to give the antigen-specific SFU. ELISpot plates were analysed using the CTL scanner and software (CTL, Germany) and further analysis carried out using GraphPad Prism (version 8.0.1) (GraphPad Software, USA).

Bronchioalveolar Lavage (BAL)

In-life BAL washes were performed using 6 ml or 10 ml PBS using a bronchioscope inserted to the right side of the lung above the second bifurcation. BAL washes performed post-mortem were conducted on the right lung lobes, after ligation of the left primary bronchus using 20 ml PBS.

Quantitative Polymerase Chain Reaction

RNA was isolated from nasal swab, throat swabs, EDTA treated whole blood, BAL and tissue samples (spleen, kidney, liver, colon, duodenum, tonsil, trachea and lung). Tissue samples in RNAprotect (Qiagen), were homogenised in a Precellys 24 homogeniser with CK28 Hard tissue homogenizing 2.0 ml tubes (Bertin) and 1 ml of RLT buffer (Qiagen) supplemented with 1% (v/v) Beta-mercaptoethanol. Tissue homogenate was passed through a QIAshredder homogenizer (Qiagen) and a volume that equated to 17.5 mg of tissue was extracted using the BioSprint™96 One-For-All vet kit (Qiagen) and Kingfisher Flex platform as per manufacturer's instructions. Non-tissue samples were inactivated by placing samples into AVL buffer (Qiagen) and adding 100% ethanol. Extraction of these samples was performed using the BioSprint™96 One-For-All vet kit (Qiagen) and Kingfisher Flex platform as per manufacturer's instructions.

Reverse transcription-quantitative polymerase chain reaction (RT-qPCR) was performed using TaqPath™ 1-Step RT-qPCR Master Mix, CG (Applied Biosystems™), 2019-nCoV CDC RUO Kit (Integrated DNA Technologies) and QuantStudio™ 7 Flex Real-Time PCR System (Applied Biosystems™). PCR amplicons were quantified against in vitro transcribed RNA N gene fragment standard. Positive samples detected below the lower limit of quantification (LLOQ) of 10 copies/µl were assigned the value of 5 copies/µl, undetected samples were assigned the value of 2.3 copies/µl, equivalent to the assays LLOD. For nasal swab, throat swab, BAL and blood samples extracted samples this equates to an LLOQ of $1.29 \times 10^4$ copies/ml and LLOD of $2.96 \times 10^3$ copies/ml. For tissue samples this equates to an LLOQ of $5.71 \times 10^4$ copies/g and LLOD of $1.31 \times 10^4$ copies/g.

Subgenomic RT-qPCR was performed on the QuantStudio™ 7 Flex Real-Time PCR System using TaqMan™ Fast Virus 1-Step Master Mix (Thermo Fisher Scientific) with forward primer, probe and reverse primer at a final concentration of 250 nM, 125 nM and 500 nM respectively. Sequences of the sgE primers and probe were: 2019-nCoV_sgE-forward, 5' CGATCTCTTGTAGATCTGTTCTC 3' (SEQ ID NO: 22729); 2019-nCoV_sgE-reverse, 5' ATATTGCAGCAGTACGCACACA 3' (SEQ ID NO: 22730); 2019-nCoV_sgE-probe, 5' FAM-ACACTAGCCATCCTTACTGCGCTTCG-BHQ1 3' (SEQ ID NO: 22731). Cycling conditions were 50° C. for 10 minutes, 95° C. for 2 minutes, followed by 45 cycles of 95° C. for 10 seconds and 60° C. for 30 seconds. RT-qPCR amplicons were quantified against an in vitro transcribed RNA standard of the full-length SARS-CoV-2 E ORF (accession number NC_045512.2) preceded by the UTR leader sequence and putative E gene transcription regulatory sequence. Positive samples detected below the lower limit of quantification (LLOQ) were assigned the value of 5 copies/µl, whilst undetected samples were assigned the value of 50.9 copies/µl, equivalent to the assays lower limit of detection (LLOD). For nasal swab, throat swab, BAL and blood samples extracted samples this equates to an LLOQ of $1.29 \times 10^4$ copies/ml and LLOD of $1.16 \times 10^3$ copies/ml. For tissue samples this equates to an LLOQ of $5.71 \times 10^4$ copies/g and LLOD of $5.14 \times 10^3$ copies/g.

Histopathology

Tissue samples from left cranial and caudal lung lobes, trachea, larynx, mediastinal lymph node, tonsil, heart, thymus, pancreas, spleen, liver, kidney, duodenum, colon, brain, vaccinating site (skin including subcutis and underlying muscle) and draining lymph node (left and right) were fixed in 10% neutral-buffered formalin and embedded into paraffin wax. 4 µm thick sections were cut and stained with haematoxylin and eosin (HE). Tissue slides were scanned and examined independently by two veterinary pathologists blinded to the treatment and group details.

For the lung, three sections from each left lung lobe were sampled from different locations: proximal, medial and distal to the primary lobar bronchus. A scoring system (Salguero et al., 2020) was used to evaluate objectively the histopathological lesions observed in the lung tissue sections. The scores for each histopathological parameter were calculated as the average of the scores observed in the six lung tissue sections evaluated per animal.

Additionally, RNAscope in-situ hybridisation (ISH) technique was used to identify the SARS-CoV-2 virus in both lung lobes. Briefly, tissues were pre-treated with hydrogen peroxide for 10 mins (RT), target retrieval for 15 mins (98-101° C.) and protease plus for 30 mins (40° C.) (all Advanced Cell Diagnostics). A V-nCoV2019-S probe (Advanced Cell Diagnostics) targeting the S-protein gene was incubated on the tissues for 2 hours at 40° C. Amplification of the signal was carried out following the RNAscope protocol (RNAscope 2.5 HD Detection Reagent—Red) using the RNAscope 2.5 HD red kit (Advanced Cell Diagnostics). Appropriate controls were included in each ISH run. Digital image analysis was carried out with Nikon NIS-Ar software in order to calculate the total area of the lung section positive for viral RNA.

Computed Tomography (CT) Radiology

CT scans were collected from sedated animals using a 16 slice Lightspeed CT scanner (General Electric Healthcare, Milwaukee, Wis., USA) in the prone and supine position. All axial scans were performed at 120 KVp, with Auto mA (ranging between 10 and 120) and were acquired using a small scan field of view. Rotation speed was 0.8 s. Images were displayed as an 11 cm field of view.

To facilitate full examination of the cardiac/pulmonary vasculature, lymph nodes and extrapulmonary tissues post-challenge, Niopam 300 (Bracco, Milan, Italy), a non-ionic, iodinated contrast medium, was administered intravenously (IV) at 2 ml/kg body weight and scans collected immediately after injection and ninety seconds from the mid-point of injection.

Scans were evaluated for the presence of COVID disease features: ground glass opacity (GGO), consolidation, crazy paving, nodules, peri-lobular consolidation; distribution—upper, middle, lower, central 2/3, peripheral, bronchocentric) and for pulmonary embolus. The extent of lung involvement was estimated (<25%, 25-50%, 51-75%, 76-100%) and quantified using a scoring system developed for COVID disease.

Results

Analysis of binding titres to either a trimeric form of the S protein or the isolated receptor binding domain (RBD)

showed a small increase in spike (FIG. 17B) and RBD-specific IgG titres (FIG. 17C) in animals vaccinated with 8 µg after a single vaccination. A greater increase was observed in IgG titres after the second vaccination on study day 42, where animals exhibited significant increases with median endpoint titres of $1.6\times10^3$ and $3.2\times10^3$ for S and RBD reactive antibodies, respectively (FIGS. 17B and C). An increase of spike- and RBD specific IgG titres was seen upon challenge in this group, particularly in serum collected at the time of termination (study days 62, 63 and 64).

As expected, no significant increase in spike or RBD-specific IgG antibodies was seen in the 0.5 µg CVnCoV (intentional sub-optimal dose) or the unvaccinated control group during the vaccination phase. However, a gradual increase in spike- and RBD specific IgG titre was observed at each of the sampling points in animals vaccinated with 0.5 µg CVnCoV after challenge (FIGS. 17B and C). No increase in spike- or RBD specific IgG titres was observed in the unvaccinated controls (FIGS. 17B and C).

In agreement with the induction of binding antibodies, robust levels of virus neutralising titres (VNTs) were detectable after the second vaccination in the 8 µg group (FIG. 17D). VNTs peaked on day 42 at median titres of $2.7\times10^4$. Neutralising antibody titres remained relatively unchanged upon challenge until day 62, 63 and 64 of the experiment. Animals in the 0.5 µg and unvaccinated control groups remained negative before challenge, while SARS-CoV-2 infection induced small increases in antibody titres in 4/6 and 5/6 animals in the 0.5 µg and unvaccinated group, respectively. Similar results were achieved with a SARS-CoV-2 virus featuring the mutation D614G.

In order to assess CVnCoV induced cellular responses, peripheral blood mononuclear cells (PBMCs) isolated at different time points post vaccination and challenge were stimulated with pools of peptides spanning the SARS-CoV-2 spike protein. IFN-γ release of stimulated cells was measured by ELISpot. Analysis of responses to summed pools in the vaccination phase showed increases in spike-specific IFN-γ in 8 µg CVnCoV vaccinated animals, two weeks after the first and, more pronounced, two weeks after the second vaccination (FIG. 18A panel 1). Stimulation with ten individual pools each covering approx. 140 amino acids of the S protein demonstrated the induction of cells reactive to peptides across the whole length of S upon vaccination with 8 µg of CVnCoV (FIG. 18A panel 3).

There were no clear responses in 0.5 µg CVnCoV or unvaccinated animals in the vaccination phase (FIG. 18A panels 1, 2 and 4). One of the female animals in the negative control group showed particularly high IFN-γ secretion after stimulation with peptide pool 2 (covering part of the N-terminal domain (NTD)) throughout the experiment and peptide pool 3 (covering part of the NTD and RBD) on d56 (FIG. 18A panel 1 and 4).

The data demonstrate the strong induction of S specific cellular responses in CVnCoV vaccinated animals. In animals vaccinated with 8 µg of CVnCoV, increasing responses against peptides covering the whole length of the S protein were elicited after first and second vaccination. These data are in line with previous data in mice that demonstrated the ability of CVnCoV to induce high S-specific CD4+ and CD8+ T cell responses (e.g. Example 6 and 7). The generation of robust T cell responses is likely to support vaccine efficacy against SARS-CoV-2. Recent data have demonstrated that CD8+T contribute to viral control in a rhesus macaque model (McMahan et al., 2020). T cell responses to SARS-CoV-2 are readily detectable in humans and may play a role in long term protection (Grifoni et al., 2020) (Sekine et al., 2020) (Ni et al., 2020).

Increased spike-specific IFN-γ responses were detectable in all animals on day 62-64 post challenge (FIG. 18B panels 1-4). Of note, increases of cellular responses in animals vaccinated with 8 µg of CVnCoV were less pronounced than in the other groups, likely indicative of lower levels of viral replication in these animals (FIG. 18B panel 3).

Quantification of viral RNA copies upon challenge infection demonstrated a reduction of viral replication in the upper respiratory tract in 8 µg CVnCoV vaccinated animals. Importantly, this vaccine dose was able to protect the lungs of challenged animals. Protection was both demonstrated by undetectable levels of viral RNA and by reduced pathological changes upon challenge infection compared to unvaccinated animals. Better protection of the lower than of the upper respiratory tract in the presence of robust immune responses is in line with the results in hamsters (Example 9) and with results of other mRNA based SARS-CoV-2 vaccines in NHP challenge models (Corbett et al., 2020) (Vogel et al., 2020).

Presence or SARS-CoV-2 total RNA in the upper and lower respiratory tract post-challenge was monitored via qRT-PCR (FIG. 19). Viral replication in the upper respiratory tract peaked on day 59 in unvaccinated animals, which reached median values of $2.7\times10^7$ cp/ml in nasal swabs (FIG. 19A) and remained detectable until termination on day 62-64. No significant difference between viral replication in animals vaccinated with 0.5 µg CVnCoV and unvaccinated control animals was measured in nose swabs. Overall, 8 µg CVnCoV vaccination induced the lowest number of viral RNA copies in the upper respiratory tract, where median values of $2.9\times10^6$ cp/ml in nasal swabs, respectively, were detectable on day 59. However, the difference between the study groups was not statistically significant. Comparable results were generated in throat swabs (FIG. 20A).

Additional analyses assessing subgenomic (sg) RNA via qRT PCR indicative of viral replication yielded overall low sgRNA levels in the upper respiratory tract. Values peaked on day 59 and returned to baseline on day 62 in all animals. In nasal swabs, sg RNA levels were lowest in CVnCoV vaccinated animals with values of $0.4\times10^4$ compared to $3.7\times10^4$ cp/ml in unvaccinated control animals. 3 of 6 animals in the 8 µg CVnCoV vaccinated group remained negative at all time points while 5/6 animals in the unvaccinated group had detectable levels of subgenomic viral RNA (FIG. 19D). Analyses of throat swabs showed no significant difference of subgenomic RNA between the groups and median values remained below the lower limit of quantification in all animals (FIG. 20B).

Parallel analyses of the lower respiratory tract of in life (d59) and post-mortem (d62-d64) bronchoalveolar lavage (BAL) samples showed significantly reduced levels of total viral RNA upon 8 µg CVnCoV vaccination at both time points (FIG. 19B). Median values of total RNA on day 59 and day 62-64 were $4.3\times10^6$ and $1.1\times10^5$ cp/ml in the control group, while animals vaccinated with 8 µg of CVnCoV featured median titres of $0.6\times10^4$ and $0.3\times10^4$, respectively. RNA levels in BAL were below the lower limit of quantification for all but one animal in the 8 µg CVnCoV group on day 59, which featured low RNA counts. Total viral RNA levels in 0.5 µg CVnCoV vaccinated animals were comparable to the control group. Of note, BAL analyses on day 59 only depict female animals and one male animal of the unvaccinated group. The remaining animals were excluded from this analysis since suboptimal BAL sampling conditions had been chosen that prevented further evaluation.

The analysis of lung tissue collected at necropsy confirmed results gained in BAL samples. Median titres of $2.9 \times 10^8$ cp/g were detectable in the unvaccinated group while all animals in the CVnCoV 8 µg vaccinated groups remained below the lower limit of quantification (FIG. 19C). There was no statistically significant difference between animals in the 0.5 µg CVnCoV and the unvaccinated group.

In terms of vaccine safety, the injection of 0.5 µg or 8 µg of CVnCoV elicited no adverse reactions to vaccination and no differences in weight or temperature were observed between groups during the vaccination phase of the study (data not shown), supporting a favourable safety profile of the vaccine in rhesus macaques at the doses used. Furthermore, no signs of vaccine enhanced disease were detectable in this study.

Subgenomic viral RNA analysis in BAL and lung tissue samples yielded comparable results: RNA indicative of replicating virus were detectable in BAL and lung samples of unvaccinated and 0.5 µg CVnCoV vaccinated animals on day 59 and day 62-64, respectively. All animals in the 8 µg CVnCoV group were negative in these analyses (FIGS. 19E and F).

Evaluation of further tissue samples collected at necropsy revealed low but detectable signals of SARS-CoV-2 total RNA in trachea and tonsils of 0.5 µg CVnCoV and unvaccinated animals, while 8 µg CVnCoV vaccinated animals remained negative (FIGS. 20C and D). No viral RNA was detectable in spleen, duodenum, colon, liver or kidney in any group (FIG. 20E-I).

Histopathological analyses of lung samples taken at necropsy showed lesions consistent with infection with SARS-CoV-2 in the lungs of challenged animals (FIG. 21). Briefly, the lung parenchyma showed multifocal to coalescing areas of pneumonia surrounded by unaffected parenchyma. Alveolar damage, with necrosis of pneumocytes was a prominent feature in the affected areas. The alveolar spaces within these areas were often thickened and damaged alveolar walls contained mixed inflammatory cells (including macrophages, lymphocytes, viable and degenerated neutrophils, and occasional eosinophils). Alveolar oedema and alveolar type II pneumocyte hyperplasia was also observed. In distal bronchioles and bronchiolo-alveolar junctions, degeneration and sloughing of epithelial cells was present. In the larger airways occasional, focal, epithelial degeneration and sloughing was observed in the respiratory epithelium. Low numbers of mixed inflammatory cells, comprising neutrophils, lymphoid cells, and occasional eosinophils, infiltrated bronchial and bronchiolar walls. In the lumen of some airways, mucus admixed with degenerated cells, mainly neutrophils and epithelial cells, was seen. Within the parenchyma, perivascular and peribronchiolar cuffing was also observed, being mostly lymphoid cells comprising the infiltrates. No remarkable changes were observed in non-pulmonary tissues.

In agreement with reduced levels of viral RNA, the evaluation of lung samples using a histopathology scoring system showed a significant reduction in severity of lung lesions in CVnCoV vaccinated animals compared to 0.5 µg CVnCoV vaccinated and unvaccinated groups (FIGS. 22A and B).

Viral RNA was observed in alveolar epithelia cells and within the inflammatory cell infiltrates (FIG. 21). The quantity of virus RNA observed by in situ hybridisation (ISH) was also significantly reduced in 8 µg CVnCoV vaccinated animals when compared to 0.5 µg CVnCoV and unvaccinated (FIG. 22C).

In order to gain an in-life view of pathological changes induced upon SARS-CoV-2 infection in the complete lung, CT scanning was performed prior to challenge and post-challenge on study day 61. Overall, the apparent level of disease was relatively mild and only affected less than 25% of the lung. Post-challenge, abnormalities in the lung were detected in 6 of 6 animals the 0.5 µg CVnCoV group, and 5 of 6 in the unvaccinated control group, while only 3/6 animals vaccinated with 8 µg CVnCoV exhibited detectable changes. Lowest levels of total scoring in CT scans were seen in animals vaccinated with 8 µg of CVnCoV (FIG. 22D). Of note, highest scores were seen in the 0.5 µg CVnCoV group in this analysis. However, values were not statistically different to the control group.

No indication of enhanced disease was detectable upon assessment of clinical signs post-challenge and the compositions were found to be highly immunogenic in rhesus macaques. There were no clear differences in body weight or temperature between groups post-challenge or any signs of fever. Vaccine enhanced disease can be caused by antibodies (antibody-dependent enhanced disease, ADE (reviewed in (Lee et al., 2020)) as previously described for a feline coronavirus (Olsen et al., 1992). Such antibodies most likely possess non-neutralising activity, and enhance viral entry causing increased viral replication and disease exacerbation. Results presented here give no indication of increased viral replication in animals vaccinated with CVnCoV. Importantly, enhanced replication in the respiratory tract or distal organs such as spleen, duodenum, colon, liver or kidney was also not detectable in the 0.5 µg group of the study. These animals featured low levels of S binding but undetectable levels of VNTs upon challenge infection, creating conditions under which ADE could hypothetically can occur.

Another cause of disease enhancement may be vaccine-associated enhanced respiratory disease (VAERD) that is hallmarked by increased inflammation due to TH2-biased immune responses and high ratios of non-neutralising to neutralising antibodies (reviewed in (Graham, 2020), (Lee et al., 2020), (Smatti et al., 2018). Analysis of lung pathology in CVnCoV vaccinated animals demonstrated protectivity of 8 µg CVnCoV and gave no indication for increased inflammation and pathological changes in suboptimally dosed animals.

The results extend our knowledge of CVnCoV safety, immunogenicity and protective efficacy in a highly relevant model system for SARS-CoV-2. The overall outcome of the study in non-human primates in terms of immunogenicity, protective efficacy and pathology are comparable to results in the hamster model (see Example 9), providing support for hamsters as a models system for SARS-CoV. Therefore, CVnCoV is highly efficacious at a low dose of 8 µg in a COVID-19 NHP challenge model while being safe at both doses tested with lack of any indication of disease enhancement.

In another similar NHP study vaccine composition comprising mRNA encoding S_stab formulated in LNPs comprising the inventive form of the 3' end (hSL-A100) and UTR combination (a-1 (HSD17B4/PSMB3)) (R9709) is analysed and compared to CVnCoV (R9515).

Example 16: Vaccination of Mice with mRNA Encoding SARS-CoV-2 Antigen S_Stab Formulated in LNPs The present example shows that SARS-CoV-2 S mRNA vaccines with mRNA comprising improved non coding regions induce strong immune responses. Some further groups of mice received mRNA vaccine composition comprising chemically modified nucleotides (N(1)-methylp-seudouridine, m1t p). One group of mice received an mRNA vaccine composition comprising mRNA produced with an alternative Cap (3'OME Clean Cap). More details are indicated in Table 22.

Preparation of LNP Formulated mRNA Vaccine:

SARS-CoV-2 S mRNA constructs are prepared as described in Example 1 (RNA in vitro transcription). HPLC purified mRNA was formulated with LNPs according to Example 1.4.

Immunostimulation of Human Peripheral Blood Mononuclear Cells (PBMCs)

Preparation of Human PBMCs

Human peripheral blood mononuclear cells (PBMCs) were isolated from whole blood of anonymous donors by standard Ficoll-Hypaque density gradient centrifugation (Ficoll 1.078 g/ml). PBMCs were washed with PBS and re-suspended in RPMI 1640 supplemented with 20% heat-inactivated FCS, 1% Penicillin/Streptomycin and 1% L-Glutamine. After counting, cells are re-suspended at 50 million cells per ml in fetal calf serum, 10% DMSO, and frozen. Before usage, the cells are thawed.

PBMC Stimulation

PBMC were stimulated with 10 µg/ml of LNP-formulated mRNA (Table 22, row B-M) at a density of 4×10 cells in a total volume of 200 µl in a humidified 5% 002 atmosphere at 37° C. To quantify background stimulation, PBMC were incubated with medium only (Table 22, row A). 24 hours after transfection, supernatants were collected.

Quantification of Cytokine Levels

Human IFNa was quantified using an IFNa ELISA from PBL according to manufacturer's instructions. PBMC supernatants were used in a 1:20 or 1:40 dilution and 50 µl of the dilution are added to 50 µl prefilled buffer.

Immunization:

Female BALB/c mice (6-8 weeks old, n=8) were injected intramuscularly (i.m.) with mRNA vaccine compositions indicated in Table 22. As a negative control, one group of mice was vaccinated with buffer (group A). All animals were vaccinated on day 0 and 21. Blood samples were collected on day 21 (post prime) and 42 (post boost) for the determination of antibody titers, splenocytes were isolated on day 42 for T-cell analysis.

TABLE 22

Vaccination regimen (Example 16):

| Group | Vaccine composition | mRNA ID | CDS opt. | 5'-UTR/3'-UTR; UTR Design | 3'-end | SEQ ID NO: Protein | SEQ ID NO: RNA | Dose | Mod. nucleotides |
|---|---|---|---|---|---|---|---|---|---|
| A | buffer | — | — | — | — | — | — | — | — |
| B | mRNA encoding S_stab formulated in LNPs | R9515 | opt1 | —/muag | A64-N5-C30-hSL-N5 | 10 | 163 | 1 µg | — |
| C | mRNA encoding S_stab formulated in LNPs | R9709 | opt1 | HSD17B4/PSMB3 | hSL-A100 | 10 | 149 | 1 µg | — |
| D | mRNA encoding S_stab formulated in LNPs | R10153 | opt1 | HSD17B4/PSMB3 | A100 | 10 | 24837 | 1 µg | — |
| E | mRNA encoding S_stab formulated in LNPs | R10154 | opt1 | —/muag | A100 | 10 | 25717 | 1 µg | — |
| F | mRNA encoding S_stab formulated in LNPs | R10155 | opt1 | Rpl31/RPS9 | hSL-A100 | 10 | 23957 | 1 µg | — |
| G | mRNA encoding S_stab formulated in LNPs | R10156 | opt1 | Rpl31/RPS9 | A100 | 10 | 25277 | 1 µg | — |
| H | mRNA encoding S_stab formulated in LNPs | R10157 | opt1 | —/muag | A64-N5-C30-hSL-N5 | 10 | 163 | 1 µg | m1ψ |
| I | mRNA encoding S_stab formulated in LNPs | R10158 | opt1 | —/muag | hSL-A100 | 10 | 24397 | 1 µg | m1ψ |
| J | mRNA encoding S_stab formulated in LNPs | R10159 | opt1 | HSD17B4/PSMB3 | hSL-A100 | 10 | 149 | 1 µg | m1ψ |
| K | mRNA encoding S_stab formulated in LNPs | R10160* | opt1 | HSD17B4/PSMB3 | hSL-A100 | 10 | 149 | 1 µg | — |
| L | mRNA encoding S formulated in LNPs | R10161* | opt1 | HSD17B4/PSMB3 | hSL-A100 | 1 | 148 | 1 µg | — |
| M | mRNA encoding S_stab formulated in LNPs | R10162 | opt10 | HSD17B4/PSMB3 | hSL-A100 | 10 | 151 | 1 µg | m1ψ |

*mRNA R10160 (group K) and R10161 (groupL) were produced with 3'OME Clean Cap.

Determination of IgG1 and IgG2 antibody titers using ELISA and virus neutralizing titers via CPE (cytopathic effect) were performed as described in Example 6. T-cell analysis by Intracellular cytokine staining (ICS) are performed as described in Example 6.

Results:

As shown in FIG. 23A mRNA encoding full length S stabilized protein (S_stab) induced different levels of IFNa in human PBMCs. For most of the constructs moderate levels of IFNa were induced, whereas LNP-formulated mRNA comprising chemically modified nucleotides did not induce IFNa.

The vaccination with mRNA encoding full length S stabilized protein (S_stab) comprising improved non-coding regions induced strong levels of virus neutralizing antibody titers (VNTs) already on day 21 after first vaccination (shown in FIG. 23B). All of the mRNA vaccine compositions with mRNAs comprising a 3' end "hSL-A100" or "A-100" (groups C-G, I-M) showed this improved, early and strong induction of VNTs. In these constructs, the poly(A) sequence is located directly at the 3' terminus of the RNA.

The introduction of chemically modified nucleotides (groups H, I, J, M) led to comparable VNTs.

After the second vaccination on day 42 (shown in FIG. 23C), most of the mRNA vaccines show a robust induction of high titers of VNTs. Also CVnCoV, vaccine composition comprising mRNA with the 3' end A64-N5-C30-hSL-N5 (group B) induced very high amount of VNT. The introduction of chemically modified nucleotides (m1ψ, group H) resulted in decreased levels. All of the mRNA vaccine compositions with mRNAs comprising a 3' end "hSL-A100"

regions induce strong immune responses. This study compares an "only prime" with a "prime-boost" vaccination regimen. Some groups of mice received mRNA vaccine composition comprising chemically modified nucleotides (N(1)-methylpseudouridine, m1ψ). More details are indicated in Table 23.

Preparation of LNP Formulated mRNA Vaccine:

SARS-CoV-2 S mRNA constructs are prepared as described in Example 1 (RNA in vitro transcription). HPLC purified mRNA was formulated with LNPs according to Example 1.4.

Immunization:

Female BALB/c mice (6-8 weeks old, n=8) were injected intramuscularly (i.m.) with mRNA vaccine compositions indicated in Table 23. As a negative control, one group of mice was vaccinated with buffer (group K). The animals were vaccinated only one time on day 0 (group A-E), or twice on day 0 and 21 (group F-J). Blood samples were collected on day 21 and 42 for the determination of antibody titers, splenocytes were isolated on day 42 for T-cell analysis.

TABLE 23

Vaccination regimen (Example 17):

| Group | Vaccine composition | mRNA ID | CDS opt. | 5'-UTR/3'-UTR; UTR Design | 3'-end | SEQ ID NO: Protein | SEQ ID NO: RNA | Dose | Mod. nucleotides |
|---|---|---|---|---|---|---|---|---|---|
| A | mRNA encoding S_stab formulated in LNPs | R9515 | opt1 | —/muag | A64-N5-C30-hSL-N5 | 10 | 163 | 1 µg day0 | — |
| B | mRNA encoding S_stab formulated in LNPs | R9709 | opt1 | HSD17B4/PSMB3 | hSL-A100 | 10 | 149 | 1 µg day0 | — |
| C | mRNA encoding S_stab formulated in LNPs | R10157 | opt1 | —/muag | A64-N5-C30-hSL-N5 | 10 | 163 | 1 µg day0 | m1ψ |
| D | mRNA encoding S_stab formulated in LNPs | R10159 | opt1 | HSD17B4/PSMB3 | hSL-A100 | 10 | 149 | 1 µg day0 | m1ψ |
| E | mRNA encoding S_stab formulated in LNPs | R10162 | opt10 | HSD17B4/PSMB3 | hSL-A100 | 10 | 151 | 1 µg day0 | m1ψ |
| F | mRNA encoding S_stab formulated in LNPs | R9515 | opt1 | —/muag | A64-N5-C30-hSL-N5 | 10 | 163 | 1 µg day0 day21 | — |
| G | mRNA encoding S_stab formulated in LNPs | R9709 | opt1 | HSD17B4/PSMB3 | hSL-A100 | 10 | 149 | 1 µg day0 day21 | — |
| H | mRNA encoding S_stab formulated in LNPs | R10157 | opt1 | —/muag | A64-N5-C30-hSL-N5 | 10 | 163 | 1 µg day0 day21 | m1ψ |
| I | mRNA encoding S_stab formulated in LNPs | R10159 | opt1 | HSD17B4/PSMB3 | hSL-A100 | 10 | 149 | 1 µg day0 day21 | m1ψ |
| J | mRNA encoding S_stab formulated in LNPs | R10162 | opt10 | HSD17B4/PSMB3 | hSL-A100 | 10 | 151 | 1 µg day0 day21 | m1ψ |
| K | buffer | — | — | — | — | — | — | day0 day21 | — | or "A-100" (groups C-G, I-M) showed this improved, early and strong induction of VNTs, irrespectively of using m1ψ or not. In these constructs, the poly(A) sequence is located directly at the 3' terminus of the RNA.

Example 17: Vaccination of Mice with mRNA Encoding SARS-CoV-2 Antigen S_Stab Formulated in LNPs The present example shows that SARS-CoV-2 S mRNA vaccines with mRNA comprising improved non coding Determination of virus neutralizing titers via CPE (cytopathic effect) were performed as described in Example 6. T-cell analysis by Intracellular cytokine staining (ICS) are performed as described in Example 6.

Results:

FIG. 24A shows the induction of VNTs after only one vaccination. As shown before in Example 17. mRNA vaccine compositions with mRNAs comprising a 3' end "hSL-A100" or "A-100" (groups A, D, E, G, I, and J)) showed improved, early and strong induction of VNTs. In these constructs, the poly(A) sequence is located directly at the 3' terminus of the RNA.

FIG. 24B demonstrate the induction of VNTs after only one vaccination (group A-E) or after two vaccination (group F-J) on day 42. mRNA vaccine composition comprising R9709 (group B) induced most prominent titers of VNTs between the groups receiving only one vaccination. The strength of vaccine composition comprising R9709 may support an immunization protocol for the treatment or prophylaxis of a subject against coronavirus, preferably SARS-CoV-2 coronavirus comprising only one single dose of the composition or the vaccine. mRNA vaccine compositions with mRNAs comprising a 3' end "hSL-A100" or "A-100" (groups A, D, E, G, I, and J)) showed improved, early and strong induction of VNTs. In these constructs, the poly(A) sequence is located directly at the 3' terminus of the RNA.

Example 18: Efficacy of mRNA Vaccines in K18-hACE2 Mouse Model for SARS-CoV-2 Infection Mice are not susceptible to infection with SARS-CoV-2, but a genetically engineered mouse model has been developed that expresses the human receptor ACE2 (hACE2), required for entry of the virus into the host cell under the K18 promoter. The model was originally developed to investigate the causative agent of SARS (SARS-CoV) (MCCRAY, Paul B., et al. Lethal infection of K18-hACE2 mice infected with severe acute respiratory syndrome coronavirus. Journal of virology, 2007, 81. Jg., Nr. 2, S. 813-821) but is now also used as a suitable small animal model for COVID-19. Previously, hACE2 mice have been shown to be susceptible to SARS-CoV-2 and to exhibit a disease course with weight loss, pulmonary pathology, and symptoms similar to those in humans (e.g. BAO, Linlin, et al. The pathogenicity of SARS-CoV-2 in hACE2 transgenic mice. Nature, 2020, 583. Jg., Nr. 7818, S. 830-833, or YINDA, Claude Kwe, et al. K18-hACE2 mice develop respiratory disease resembling severe COVID-19. PLoS pathogens, 2021, 17. Jg., Nr. 1, S. e1009195; DE ALWIS, Ruklanthi M., et al. A Single Dose of Self-Transcribing and Replicating RNA Based SARS-CoV-2 Vaccine Produces Protective Adaptive Immunity In Mice. BioRxiv, 2020). In principle, the K18-hACE2 mouse is suitable for vaccine studies to investigate the prevention of infection with SARS-CoV-2 or the reduction of viral load, and at the same time to investigate the correlates and causes of a protective effect of an mRNA vaccine against COVID-19 with well-established immunological methods, which are generally available for mouse models.

The present example shows that SARS-CoV-2 S mRNA vaccines induce strong humoral as well as cellular immune response in K18-hACE2 mice. SARS-CoV-2 S mRNA vaccines protect K18-hACE2 mice from SARS-CoV-2 viral challenge, which can be shown e.g. by measuring the viral loads of infected animals, by monitoring the disease progression with weight loss, pulmonary pathology and other symptoms, or by histopathology and survival.

Preparation of LNP Formulated mRNA Vaccine:

SARS-CoV-2 S mRNA constructs are prepared as described in Example 1 (RNA in vitro transcription). HPLC purified mRNA was formulated with LNPs according to Example 1.4 prior to use in in vivo vaccination experiments.

Immunization and Challenge:

K18-hACE2 mice are injected intramuscularly (i.m.) with mRNA vaccine compositions and doses as indicated in Table 24. As a negative control, one group is vaccinated with buffer. As a control, one group is injected intramuscularly with, 20 μl Formalin-inactivated SARS-CoV-2 virus ($10^6$ PFU) adjuvanted with Alum. All animals were vaccinated on day 0 and day 28. Blood samples were collected on day 0, day 28 (post prime) and 56 (post boost, before challenge) for the determination of antibody titers. The animals are challenged intranasally with e.g. $10^5$ PFU SARS-CoV-2 (Bavaria 1) at day 56. Animals were followed for four to ten days post challenge.

TABLE 24

Vaccination regimen (Example 18):

| Group | Vaccine composition | mRNA ID | CDS opt. | 5'-UTR/3'-UTR; UTR Design | 3'-end | SEQ ID NO: Protein | SEQ ID NO: RNA | Dose |
|---|---|---|---|---|---|---|---|---|
| A | buffer | — | — | | | — | — | 20 μl |
| B | mRNA encoding S_stab formulated in LNPs | R9515 | opt1 | —/muag; | A64-N5-C30-hSL-N5 | 10 | 163 | 8 μg |
| C | mRNA encoding S_stab formulated in LNPs | R9709 | opt1 | HSD17B4/PSMB3 | hSL-A100 | 10 | 149 | 8 μg |
| D | mRNA encoding S_stab formulated in LNPs | R9709 | opt1 | HSD17B4/PSMB3 | hSL-A100 | 10 | 149 | 2 μg |
| E | mRNA encoding S_stab formulated in LNPs | R9709 | opt1 | HSD17B4/PSMB3 | hSL-A100 | 10 | 149 | 0.5 μg |
| F | Formalin-in activated virus + Alum | — | — | — | — | — | — | $10^6$ PFU, 20 μl, |

Determination of IgG1 and IgG2 antibody titers using ELISA, determination of virus neutralizing titers via CPE (cytopathic effect)-based microneutralization assay and T-cell analysis by Intracellular cytokine staining (ICS) are performed as described in Example 6.

The immunization and challenge of K18-hACE2 mice as described in the present Example can be used to determine the protective efficacy of further inventive mRNA constructs and compositions. Furthermore, by using mutated virus variants or isolates of SARS-CoV-2 (e.g. B.1.351 see also Table 25), it can be shown, that the inventive mRNA vaccine compositions are effective in addition against these mutated virus variants or isolates.

Example 19: Neutralizing Activity of mRNA Vaccines Against Emerging SARS-CoV-2 Variants The neutralizing activity of sera from 20 phase 1 clinical trial participants (aged 18-60 years, male and female) who received two doses of 2 µg, 4 µg, 8 µg, or 12 µg CVnCoV (see Example 10 regarding the clinical study outline) is tested against emerging SARS-CoV-2 variants or isolates. The serum samples were obtained on days 36, 43 or 57 of the clinical study and exhibit Virus neutralizing antibody titers (VNTs) at a range of 10-1280 (MN 25TCID50), representing samples with low (10-20) and with high (452-1280) VNTs.

VNTs are analysed as described e.g. for the analysis of hamster sera in Example 9, whereby the serum samples are incubated with emerging virus variants. Strain SARS-CoV-2/human/ITA/INMI1/2020 or UVE/SARS-CoV-2/2020/FR/702 can be used as reference ("wildtype strain"). Emerging SARS-CoV-2 variants or isolates for analysis are listed in Table 25. Further variants may arise and can be tested as well.

TABLE 25

List of emerging SARS-CoV-2 variants (Example 19):

| Variant | Amino acid changes in spike protein |
| --- | --- |
| Mink Cluster 5 variant GISAID: EPI_ISL_616802 (hCoV-19/Denmark/DCGC-3024/2020) | delH69, delV70, Y453F, D614G, I692V, M1229I |
| B.1.1.7 (a.k.a., 20B/501Y.V1, 501Y.V1, Variant of Concern-202012/01, VOC-202012/01, VUI-202012/01, B117, "UK variant") | delH69, delV70, delY144, N501Y, A570D, D614G, P681H, T716I, S982A, D1118H |
| B.1.351 (a.k.a., 20C/501Y.V2, 501Y.V2, N501Y.V2, "SA variant", "South Africa variant") | L18F, D80A, D215G, delL242, delA243, delL244, R246I, K417N, E484K, N501Y, D614G, A701V |
| P.1 (a.k.a., "Brazil variant" = "Japan variant") | L18F, T20N, P26S, D138Y, R190S, K417T, E484K, N501Y, D614G, H655Y, T1027I |
| CAL.20C (a.k.a., "California variant") NCBI: QQN00429.1 (CAL.20.C example: SARS-CoV-2/human/USA/CA-LACPHL-AF00114/2021) | S13I, W152C, L452R, D614G |

Neutralization can also be measured by a recombinant VSV- or lentiviral-based pseudovirus neutralization (PsVN) assay that incorporates the spike mutations present in the SARS-CoV-2 variant strain.

The capacity of binding antibodies can be tested in ELISA assays as described above in e.g. Example 10 with recombinant spike proteins for coating featuring the mutations of emerging virus variant.

The efficacy of mRNA vaccine can also be tested in challenge models as described e.g. in Example 17 for hACE-mice, in Example 15 for NHPs, and in Example 9 for hamsters using an emerging SARS-Cov-2 variant for the challenge infection.

SEQUENCE LISTING (26945 sequences)

SEQ ID NO: 1 - protein, 1273 aa, synthetic construct
  REGION 1..1273: note = SARS-CoV-2/Wuhan/WIV05/2019__EPI_ISL_402128 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 2 - protein, 1269 aa, synthetic construct
  REGION 1..1269: note = SARS-CoV-2/bat/Yunnan/RaTG13/2013__EPI_ISL_402131 spike protein (1-1269)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 3 - protein, 1273 aa, synthetic construct
  REGION 1..1273: note = SARS-CoV-2/Wuhan/HBCDC-HB-01/2019__EPI_ISL_402132 spike protein (1-1273)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 4 - protein, 1273 aa, synthetic construct
  REGION 1..1273: note = SARS-CoV-2/Guangdong/20SF028/2020__EPI_ISL_403936 spike protein (1-1273)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 5 - protein, 1273 aa, synthetic construct
  REGION 1..1273: note = SARS-CoV-2/Shenzhen/SZTH-001/2020__EPI_ISL_406592 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 6 - protein, 1273 aa, synthetic construct
  REGION 1..1273: note = SARS-CoV-2/Shenzhen/SZTH-004/2020__EPI_ISL_406595 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 7 - protein, 1273 aa, synthetic construct
  REGION 1..1273: note = SARS-CoV-2/France/IDF0372/2020__EPI_ISL_406596 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 8 - protein, 1273 aa, synthetic construct
  REGION 1..1273: note = SARS-CoV-2/Australia/VIC01/2020__EPI_ISL_406844 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 9 - protein, 1273 aa, synthetic construct
  REGION 1..1273: note = SARS-CoV-2/Germany/BavPat1/2020__EPI_ISL_406862 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 10 - protein, 1273 aa, synthetic construct
  REGION 1..1273: note = SARS-CoV-2/Wuhan/WIV05/2019__EPI_ISL_402128 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 11 - protein, 1269 aa, synthetic construct
  REGION 1..1269: note = SARS-CoV-2/bat/Yunnan/RaTG13/2013__EPI_ISL_402131 spike protein (1-1269)(K982P_V983P)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 12 - protein, 1273 aa, synthetic construct
  REGION 1..1273: note = SARS-CoV-2/Wuhan/HBCDC-HB-01/2019__EPI_ISL_402132 spike protein (1-1273)(K986P_V987P)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13 - protein, 1273 aa, synthetic construct
  REGION 1..1273: note = SARS-CoV-2/Guangdong/20SF028/2020__EPI_ISL_403936 spike protein (1-1273)(K986P_V987P)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 14 - protein, 1273 aa, synthetic construct
  REGION 1..1273: note = SARS-CoV-2/Shenzhen/SZTH-001/2020__EPI_ISL_406592 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 15 - protein, 1273 aa, synthetic construct
  REGION 1..1273: note = SARS-CoV-2/Shenzhen/SZTH-004/2020__EPI_ISL_406595 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 16 - protein, 1273 aa, synthetic construct
  REGION 1..1273: note = SARS-CoV-2/France/IDF0372/2020__EPI_ISL_406596 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 17 - protein, 1273 aa, synthetic construct
  REGION 1..1273: note = SARS-CoV-2/Australia/VIC01/2020__EPI_ISL_406844 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 18 - protein, 1273 aa, synthetic construct
  REGION 1..1273: note = SARS-CoV-2/Germany/BavPat1/2020__EPI_ISL_406862 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 19 - protein, 1273 aa, synthetic construct
  REGION 1..1273: note = SARS-CoV-2/Wuhan/WIV05/2019__EPI_ISL_402128 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 20 - protein, 1273 aa, synthetic construct
  REGION 1..1273: note = SARS-CoV-2/Wuhan/WIV05/2019__EPI_ISL_402128 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 21 - protein, 1273 aa, synthetic construct
  REGION 1..1273: note = SARS-CoV-2/Wuhan/WIV05/2019__EPI_ISL_402128 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22 - protein, 1273 aa, synthetic construct
  REGION 1..1273: note = SARS-CoV-2/Wuhan/WIV05/2019__EPI_ISL_402128 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 23 - protein, 1273 aa, synthetic construct
  REGION 1..1273: note = SARS-CoV-2/Wuhan/WIV05/2019__EPI_ISL_402128 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 24 - protein, 1273 aa, synthetic construct
  REGION 1..1273: note = SARS-CoV-2/Wuhan/WIV05/2019__EPI_ISL_402128 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 25 - protein, 1273 aa, synthetic construct
  REGION 1..1273: note = SARS-CoV-2/Wuhan/WIV05/2019__EPI_ISL_402128 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 26 - protein, 1273 aa, synthetic construct
  REGION 1..1273: note = SARS-CoV-2/Wuhan/WIV05/2019__EPI_ISL_402128 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 27 - protein, 681 aa, synthetic construct
  REGION 1..681: note = SARS-CoV-2/Wuhan/WIV05/2019__EPI_ISL_402128 spike protein (1-681)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSP

SEQ ID NO: 28 - protein, 15 aa, synthetic construct
  REGION 1..15: note = SARS-CoV-2/Wuhan/WIV05/2019__EPI_ISL_402128 spike protein (1-15)
MFVFLVLLPLVSSQC

SEQ ID NO: 29 - protein, 666 aa, synthetic construct
  REGION 1..666: note = SARS-CoV-2/Wuhan/WIV05/2019__EPI_ISL_402128 spike protein (16-681)
VNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSP

SEQ ID NO: 30 - protein, 592 aa, synthetic construct
  REGION 1..592: note = SARS-CoV-2/Wuhan/WIV05/2019__EPI_ISL_402128 spike protein (682-1273)
RRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 31 - protein, 1211 aa, synthetic construct
  REGION 1..1211: note = SARS-CoV-2/Wuhan/WIV05/2019__EPI_ISL_402128 spike protein (1-1211)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 32 - protein, 1207 aa, synthetic construct
  REGION 1..1207: note = SARS-CoV-2/bat/Yunnan/RaTG13/2013__EPI_ISL_402131 spike protein (1-1207)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 33 - protein, 1211 aa, synthetic construct
  REGION 1..1211: note = SARS-CoV-2/Wuhan/HBCDC-HB-01/2019__EPI_ISL_402132 spike protein (1-1211)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 34 - protein, 1211 aa, synthetic construct
  REGION 1..1211: note = SARS-CoV-2/Guangdong/20SF028/2020__EPI_ISL_403936 spike protein (1-1211)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 35 - protein, 1211 aa, synthetic construct
  REGION 1..1211: note = SARS-CoV-2/Shenzhen/SZTH-001/2020__EPI_ISL_406592 spike protein (1-1211)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIK

SEQ ID NO: 36 - protein, 1211 aa, synthetic construct
  REGION 1..1211: note = SARS-CoV-2/Shenzhen/SZTH-004/2020__EPI_ISL_406595 spike protein (1-1211)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 37 - protein, 1211 aa, synthetic construct
  REGION 1..1211: note = SARS-CoV-2/France/IDF0372/2020__EPI_ISL_406596 spike protein (1-1211)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 38 - protein, 1211 aa, synthetic construct
  REGION 1..1211: note = SARS-CoV-2/Australia/VIC01/2020__EPI_ISL_406844 spike protein (1-1211)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 39 - protein, 1211 aa, synthetic construct
  REGION 1..1211: note = SARS-CoV-2/Germany/BavPat1/2020__EPI_ISL_406862 spike protein (1-1211)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 40 - protein, 1211 aa, synthetic construct
  REGION 1..1211: note = SARS-CoV-2/Wuhan/WIV05/2019__EPI_ISL_402128 spike protein (1-1211)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 41 - protein, 1207 aa, synthetic construct
  REGION 1..1207: note = SARS-CoV-2/bat/Yunnan/RaTG13/2013__EPI_ISL_402131 spike protein (1-1207)(K982P_V983P)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 42 - protein, 1211 aa, synthetic construct
  REGION 1..1211: note = SARS-CoV-2/Wuhan/HBCDC-HB-01/2019__EPI_ISL_402132 spike protein (1-1211)(K986P_V987P)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 43 - protein, 1211 aa, synthetic construct
  REGION 1..1211: note = SARS-CoV-2/Guangdong/20SF028/2020__EPI_ISL_403936 spike protein (1-1211)(K986P_V987P)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 44 - protein, 1211 aa, synthetic construct
  REGION 1..1211: note = SARS-CoV-2/Shenzhen/SZTH-001/2020__EPI_ISL_406592 spike protein (1-1211)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIK

SEQ ID NO: 45 - protein, 1211 aa, synthetic construct
  REGION 1..1211: note = SARS-CoV-2/Shenzhen/SZTH-004/2020__EPI_ISL_406595 spike protein (1-1211)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 46 - protein, 1211 aa, synthetic construct
  REGION 1..1211: note = SARS-CoV-2/France/IDF0372/2020__EPI_ISL_406596 spike protein (1-1211)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 47 - protein, 1211 aa, synthetic construct
  REGION 1..1211: note = SARS-CoV-2/Australia/VIC01/2020__EPI_ISL_406844 spike protein (1-1211)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 48 - protein, 1211 aa, synthetic construct
  REGION 1..1211: note = SARS-CoV-2/Germany/BavPat1/2020__EPI_ISL_406862 spike protein (1-1211)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 49 - protein, 62 aa, synthetic construct
  REGION 1..62: note = SARS-CoV-2/Wuhan/WIV05/2019__EPI_ISL_402128 spike protein (1212-1273)
WPWYIWLGFIAGLIAIVMVTIMLCCMTSCCSCLKGCCSCGSCCKFDEDDSEPVLKGVKLHYT

SEQ ID NO: 50 - protein, 62 aa, synthetic construct
  REGION 1..62: note = SARS-CoV-2/bat/Yunnan/RaTG13/2013__EPI_ISL_402131 spike protein (1208-1269)
WPWYIWLGFIAGLIAIIMVTIMLCCMTSCCSCLKGCCSCGSCCKFDEDDSEPVLKGVKLHYT

SEQ ID NO: 51 - protein, 62 aa, synthetic construct; identical to SEQ ID NO: 49
  REGION 1..62: note = SARS-CoV-2/Wuhan/HBCDC-HB-01/2019__EPI_ISL_402132 spike protein (1212-1273)

SEQ ID NO: 52 - protein, 62 aa, synthetic construct; identical to SEQ ID NO: 49
  REGION 1..62: note = SARS-CoV-2/Guangdong/20SF028/2020__EPI_ISL_403936 spike protein (1212-1273)

SEQ ID NO: 53 - protein, 62 aa, synthetic construct
  REGION 1..62: note = SARS-CoV-2/Shenzhen/SZTH-001/2020__EPI_ISL_406592 spike protein (1212-1273)
WPWYIWLGFIAGLIAIVMVTIMLCCMTSCCSCLKGCCSCGSCCKFDEDDSGPVLKGVKLHYT

SEQ ID NO: 54 - protein, 62 aa, synthetic construct; identical to SEQ ID NO: 49
  REGION 1..62: note = SARS-CoV-2/Shenzhen/SZTH-004/2020__EPI_ISL_406595 spike protein (1212-1273)

SEQ ID NO: 55 - protein, 62 aa, synthetic construct; identical to SEQ ID NO: 49
  REGION 1..62: note = SARS-CoV-2/France/IDF0372/2020__EPI_ISL_406596 spike protein (1212-1273)

SEQ ID NO: 56 - protein, 62 aa, synthetic construct; identical to SEQ ID NO: 49
  REGION 1..62: note = SARS-CoV-2/Australia/VIC01/2020__EPI_ISL_406844 spike protein (1212-1273)

SEQ ID NO: 57 - protein, 62 aa, synthetic construct; identical to SEQ ID NO: 49
  REGION 1..62: note = SARS-CoV-2/Germany/BavPat1/2020__EPI_ISL_406862 spike protein (1212-1273)

SEQ ID NO: 58 - protein, 1371 aa, synthetic construct
  REGION 1..1371: note = SARS-CoV-2/Wuhan/WIV05/2019__EPI_ISL_402128 spike protein (1-1211) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 59 - protein, 1367 aa, synthetic construct
  REGION 1..1367: note = SARS-CoV-2/bat/Yunnan/RaTG13/2013__EPI_ISL_402131 spike protein (1-1207) LumSynth construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 60 - protein, 1371 aa, synthetic construct
  REGION 1..1371: note = SARS-CoV-2/Wuhan/HBCDC-HB-01/2019__EPI_ISL_402132 spike protein (1-1211) LumSynth construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 61 - protein, 1371 aa, synthetic construct
  REGION 1..1371: note = SARS-CoV-2/Guangdong/20SF028/2020__EPI_ISL_403936 spike protein (1-1211) LumSynth construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 62 - protein, 1371 aa, synthetic construct
  REGION 1..1371: note = SARS-CoV-2/Shenzhen/SZTH-001/2020__EPI_ISL_406592 spike protein (1-1211) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 63 - protein, 1371 aa, synthetic construct
  REGION 1..1371: note = SARS-CoV-2/Shenzhen/SZTH-004/2020__EPI_ISL_406595 spike protein (1-1211) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 64 - protein, 1371 aa, synthetic construct
  REGION 1..1371: note = SARS-CoV-2/France/IDF0372/2020__EPI_ISL_406596 spike protein (1-1211) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 65 - protein, 1371 aa, synthetic construct
  REGION 1..1371: note = SARS-CoV-2/Australia/VIC01/2020__EPI_ISL_406844 spike protein (1-1211) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 66 - protein, 1371 aa, synthetic construct
  REGION 1..1371: note = SARS-CoV-2/Germany/BavPat1/2020__EPI_ISL_406862 spike protein (1-1211) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 67 - protein, 1377 aa, synthetic construct
  REGION 1..1377: note = SARS-CoV-2/Wuhan/WIV05/2019__EPI_ISL_402128 spike protein (1-1211) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 68 - protein, 1373 aa, synthetic construct
  REGION 1..1373: note = SARS-CoV-2/bat/Yunnan/RaTG13/2013__EPI_ISL_402131 spike protein (1-1207) Ferritin construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 69 - protein, 1377 aa, synthetic construct
  REGION 1..1377: note = SARS-CoV-2/Wuhan/HBCDC-HB-01/2019__EPI_ISL_402132 spike protein (1-1211) Ferritin construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 70 - protein, 1377 aa, synthetic construct
  REGION 1..1377: note = SARS-CoV-2/Guangdong/20SF028/2020__EPI_ISL_403936 spike protein (1-1211) Ferritin construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 71 - protein, 1377 aa, synthetic construct
  REGION 1..1377: note = SARS-CoV-2/Shenzhen/SZTH-001/2020__EPI_ISL_406592 spike protein (1-1211) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 72 - protein, 1377 aa, synthetic construct
  REGION 1..1377: note = SARS-CoV-2/Shenzhen/SZTH-004/2020__EPI_ISL_406595 spike protein (1-1211) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 73 - protein, 1377 aa, synthetic construct
  REGION 1..1377: note = SARS-CoV-2/France/IDF0372/2020__EPI_ISL_406596 spike protein (1-1211) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 74 - protein, 1377 aa, synthetic construct
  REGION 1..1377: note = SARS-CoV-2/Australia/VIC01/2020__EPI_ISL_406844 spike protein (1-1211) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 75 - protein, 1377 aa, synthetic construct
  REGION 1..1377: note = SARS-CoV-2/Germany/BavPat1/2020__EPI_ISL_406862 spike protein (1-1211) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 76 - protein, 1241 aa, synthetic construct
  REGION 1..1241: note = SARS-CoV-2/Wuhan/WIV05/2019__EPI_ISL_402128 spike protein (1-1211) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 77 - protein, 1237 aa, synthetic construct
  REGION 1..1237: note = SARS-CoV-2/bat/Yunnan/RaTG13/2013__EPI_ISL_402131 spike protein (1-1207) Foldon construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 78 - protein, 1241 aa, synthetic construct
  REGION 1..1241: note = SARS-CoV-2/Wuhan/HBCDC-HB-01/2019__EPI_ISL_402132 spike protein (1-1211) Foldon construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 79 - protein, 1241 aa, synthetic construct
  REGION 1..1241: note = SARS-CoV-2/Guangdong/20SF028/2020__EPI_ISL_403936 spike protein (1-1211) Foldon construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 80 - protein, 1241 aa, synthetic construct
  REGION 1..1241: note = SARS-CoV-2/Shenzhen/SZTH-001/2020__EPI_ISL_406592 spike protein (1-1211) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 81 - protein, 1241 aa, synthetic construct
  REGION 1..1241: note = SARS-CoV-2/Shenzhen/SZTH-004/2020__EPI_ISL_406595 spike protein (1-1211) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 82 - protein, 1241 aa, synthetic construct
  REGION 1..1241: note = SARS-CoV-2/France/IDF0372/2020__EPI_ISL_406596 spike protein (1-1211) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 83 - protein, 1241 aa, synthetic construct
  REGION 1..1241: note = SARS-CoV-2/Australia/VIC01/2020__EPI_ISL_406844 spike protein (1-1211) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 84 - protein, 1241 aa, synthetic construct
  REGION 1..1241: note = SARS-CoV-2/Germany/BavPat1/2020__EPI_ISL_406862 spike protein (1-1211) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 85 - protein, 1371 aa, synthetic construct
  REGION 1..1371: note = SARS-CoV-2/Wuhan/WIV05/2019__EPI_ISL_402128 spike protein (1-1211)(K986P_V987P) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 86 - protein, 1367 aa, synthetic construct
  REGION 1..1367: note = SARS-CoV-2/bat/Yunnan/RaTG13/2013__EPI_ISL_402131 spike protein (1-1207)(K982P_V983P) LumSynth construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 87 - protein, 1371 aa, synthetic construct
  REGION 1..1371: note = SARS-CoV-2/Wuhan/HBCDC-HB-01/2019__EPI_ISL_402132 spike protein (1-1211)(K986P_V987P) LumSynth construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 88 - protein, 1371 aa, synthetic construct
  REGION 1..1371: note = SARS-CoV-2/Guangdong/20SF028/2020__EPI_ISL_403936 spike protein (1-1211)(K986P_V987P) LumSynth construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 89 - protein, 1371 aa, synthetic construct
  REGION 1..1371: note = SARS-CoV-2/Shenzhen/SZTH-001/2020__EPI_ISL_406592 spike protein (1-1211)(K986P_V987P) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 90 - protein, 1371 aa, synthetic construct
  REGION 1..1371: note = SARS-CoV-2/Shenzhen/SZTH-004/2020__EPI_ISL_406595 spike protein (1-1211)(K986P_V987P) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 91 - protein, 1371 aa, synthetic construct
  REGION 1..1371: note = SARS-CoV-2/France/IDF0372/2020__EPI_ISL_406596 spike protein (1-1211)(K986P_V987P) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 92 - protein, 1371 aa, synthetic construct
  REGION 1..1371: note = SARS-CoV-2/Australia/VIC01/2020__EPI_ISL_406844 spike protein (1-1211)(K986P_V987P) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 93 - protein, 1371 aa, synthetic construct
  REGION 1..1371: note = SARS-CoV-2/Germany/BavPat1/2020__EPI_ISL_406862 spike protein (1-1211)(K986P_V987P) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 94 - protein, 1377 aa, synthetic construct
  REGION 1..1377: note = SARS-CoV-2/Wuhan/WIV05/2019__EPI_ISL_402128 spike protein (1-1211)(K986P_V987P) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 95 - protein, 1373 aa, synthetic construct
  REGION 1..1373: note = SARS-CoV-2/bat/Yunnan/RaTG13/2013__EPI_ISL_402131 spike protein (1-1207)(K982P_V983P) Ferritin construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 96 - protein, 1377 aa, synthetic construct
  REGION 1..1377: note = SARS-CoV-2/Wuhan/HBCDC-HB-01/2019__EPI_ISL_402132 spike protein (1-1211)(K986P_V987P) Ferritin construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 97 - protein, 1377 aa, synthetic construct
  REGION 1..1377: note = SARS-CoV-2/Guangdong/20SF028/2020__EPI_ISL_403936 spike protein (1-1211)(K986P_V987P) Ferritin construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 98 - protein, 1377 aa, synthetic construct
  REGION 1..1377: note = SARS-CoV-2/Shenzhen/SZTH-001/2020__EPI_ISL_406592 spike protein (1-1211)(K986P_V987P) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 99 - protein, 1377 aa, synthetic construct
  REGION 1..1377: note = SARS-CoV-2/Shenzhen/SZTH-004/2020__EPI_ISL_406595 spike protein (1-1211)(K986P_V987P) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 100 - protein, 1377 aa, synthetic construct
  REGION 1..1377: note = SARS-CoV-2/France/IDF0372/2020__EPI_ISL_406596 spike protein (1-1211)(K986P_V987P) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 101 - protein, 1377 aa, synthetic construct
  REGION 1..1377: note = SARS-CoV-2/Australia/VIC01/2020__EPI_ISL_406844 spike protein (1-1211)(K986P_V987P) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 102 - protein, 1377 aa, synthetic construct
  REGION 1..1377: note = SARS-CoV-2/Germany/BavPat1/2020__EPI_ISL_406862 spike protein (1-1211)(K986P_V987P) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 103 - protein, 1241 aa, synthetic construct
  REGION 1..1241: note = SARS-CoV-2/Wuhan/WIV05/2019__EPI_ISL_402128 spike protein (1-1211)(K986P_V987P) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 104 - protein, 1237 aa, synthetic construct
  REGION 1..1237: note = SARS-CoV-2/bat/Yunnan/RaTG13/2013__EPI_ISL_402131 spike protein (1-1207)(K982P_V983P) Foldon construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 105 - protein, 1241 aa, synthetic construct
  REGION 1..1241: note = SARS-CoV-2/Wuhan/HBCDC-HB-01/2019__EPI_ISL_402132 spike protein (1-1211)(K986P_V987P) Foldon construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 106 - protein, 1241 aa, synthetic construct
  REGION 1..1241: note = SARS-CoV-2/Guangdong/20SF028/2020__EPI_ISL_403936 spike protein (1-1211)(K986P_V987P) Foldon construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 107 - protein, 1241 aa, synthetic construct
  REGION 1..1241: note = SARS-CoV-2/Shenzhen/SZTH-001/2020__EPI_ISL_406592 spike protein (1-1211)(K986P_V987P) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 108 - protein, 1241 aa, synthetic construct
  REGION 1..1241: note = SARS-CoV-2/Shenzhen/SZTH-004/2020__EPI_ISL_406595 spike protein (1-1211)(K986P_V987P) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 109 - protein, 1241 aa, synthetic construct
  REGION 1..1241: note = SARS-CoV-2/France/IDF0372/2020__EPI_ISL_406596 spike protein (1-1211)(K986P_V987P) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 110 - protein, 1241 aa, synthetic construct
  REGION 1..1241: note = SARS-CoV-2/Australia/VIC01/2020__EPI_ISL_406844 spike protein (1-1211)(K986P_V987P) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 111 - protein, 1241 aa, synthetic construct
  REGION 1..1241: note = SARS-CoV-2/Germany/BavPat1/2020__EPI_ISL_406862 spike protein (1-1211)(K986P_V987P) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 112 - protein, 153 aa, synthetic construct
  REGION 1..153: note = Aa/VF5_ribH(C37A_N102D) Lumazine Synthase (LumSynth)
QIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 113 - protein, 163 aa, synthetic construct
  REGION 1..163: note = Hp/J99_pfr(5-167_N19Q) Ferritin
DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 114 - protein, 27 aa, synthetic construct
  REGION 1..27: note = BPT4_wac(458-484) Foldon
GYIPEAPRDGQAYVRKDGEWVLLSTFL

SEQ ID NO: 115 - protein, 7 aa, synthetic construct
  REGION 1..7: note = Linker GGGSGGG
GGGSGGG

SEQ ID NO: 116 - RNA, 3822 nt, synthetic construct
  misc_feature 1..3822: note = SARS-CoV-2/Wuhan/WIV05/2019__EPI_ISL_402128 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 117 - RNA, 3822 nt, synthetic construct
  misc_feature 1..3822: note = SARS-CoV-2/Wuhan/WIV02/2019__EPI_ISL_402127 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaagttgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 118 - RNA, 3810 nt, synthetic construct
  misc_feature 1..3810: note = SARS-CoV-2/bat/Yunnan/RaTG13/2013__EPI_ISL_402131 spike protein CDS wt (1-1269)
  source 1..3810: mol_type = other RNA
atgtttgtttttcttgttttattgccactagtttctagtcagtgtgttaatctaacaactagaactcagttacctcctgcatacaccaactcatccacccgtggtgtctattaccctgacaaagttttcagatcttcagttttacatttaactcaggatttgtttttacctttcttctccaatgtgacctggttccatgctatacatgtttcagggaccaatggtattaaaaggtttgataacccagttctgccattcaacgatggcgtctattttgcttccactgagaagtctaatataataagaggatggatttttggtactaccttagattcgaagacccagtctctacttattgttaataacgctactaatgttgttattaaagtctgtgaatttcaattttgtaatgatccatttttgggtgtttattaccacaaaaacaacaaaagttggatggaaagtgagttcagagtttactctagtgcgaataattgcacttttgagtatgtctctcagccttttcttatggaccttgaaggaaaacagggtaatttcaaaaatcttagggaattcgtgtttaagaatattgatggttatttcaaaatatattctaaacatacgcctattaatttagtgcgtgatcttccccctggtttttcagctttagaaccattggtagatctgccaataggtattaacatcactaggtttcaaactttacttgctttacatagaagctatttgactcctggtgattcttcttcaggttggacagctggtgctgcagcttattatgtgggttatcttcaaccaaggacttttctactaaaatataatgagaatggaaccattacagatgctgtagactgtgcacttgaccctctttcagaaacaaagtgtacgttaaaatccttcactgttgaaaaaggaatttatcaaacctctaactttagagtccaaccaacagattctattgttagattcccaaatattacaaacttatgtccttttggtgaagtttttaacgccaccacattcgcatcagtttatgcttggaacagaaagagaattagcaactgtgttgctgattactctgtcctatataattccacttcattttctacctttaaatgttatggagtgtctcctactaaattaaatgatctctgctttactaatgtttatgcagactcatttgtgattacaggtgatgaagtcagacaaattgcgccaggacaaactggaaagattgctgactacaattataaactaccagatgattttactggttgtgttatagcttggaattctaagcatattgatgcaaaagagggcggtaattttaactatctttaccgtctctttagaaaagctaatcttaaaccctttgagagggatatctcaactgaaatttaccaagcaggcagcaaaccttgtaatggtcaaactggtctaaattgctactacccactttatagatatggattttaccctactgatggtgttggtcaccaaccttatagggtagtagtactttcttttgaacttctaaatgcaccagcaactgtttgtggacctaagaagtctactaacttggttaaaaataaatgtgtcaatttcaactttaatggtttaactggcacaggtgtcctcacagagtctaataaaaagtttctacctttccaacaatttggtagagacattgcagacactactgatgccgtccgtgatccacagacacttgagattcttgacattacaccatgttcttttggtggtgtcagtgttataacacctggaacaaatgcctctaaccaggttgctgttctttatcaggatgttaactgcacagaagtccctgttgctatccatgcagaccaacttactcccacttggcgtgtttactccacaggttctaatgtttttcaaacacgtgcaggttgtttaataggggctgaacatgtcaataactcgtatgagtgtgacatacctattggtgcaggaatatgcgccagttatcagactcaaactaattcacgtagtgtggccagtcaatctattattgcctacactatgtcacttggtgcagaaaattcagttgcttattctaataactctattgccatacctacaaattttactattagtgtgaccactgaaattctacctgtgtctatgacaaagacatcggtagactgtacaatgtatatttgtggtgattcaactgagtgcagcaaccttttgttgcaatatggtagtttttgcacacaattaaatcgtgctttaactggaatagctgttgaacaggacaaaaatactcaagaagtttttgctcaagttaaacaaatttataagacaccaccaattaaagattttggtggtttcaatttttcacaaatattaccagatccatcaaaaccaagcaagaggtcatttattgaggatttacttttcaataaagtgacacttgctgatgctggcttcatcaaacaatatggtgattgccttggtgatattgctgctagggatcttatttgtgctcaaaagttcaatggccttactgttctgccacctttgctcacagatgaaatgatcgctcaatacacttctgcactattagcaggtacaatcacttctggttggacttttggtgcaggtgctgctttacaaataccatttgccatgcaaatggcttataggtttaatggtattggagttacacagaatgttctctatgagaaccaaaaattgattgccaaccagtttaatagtgctattggcaaaattcaagactcactttcttctacagcaagtgcacttggaaaacttcaagatgttgtcaaccaaaatgcacaagctttaaacacgcttgttaaacaacttagctccaattttggagctatttctagcgtgttaaatgatatcctttcacgtctcgacaaagttgaggctgaagtgcagattgacaggttgatcacaggcagacttcaaagcttgcagacatatgtgactcaacaattaattagagctgcagaaatcagagcttctgccaatcttgctgctactaaaatgtcagagtgtgtactcggacaatcaaaaagagttgatttttgtggaaaaggctatcatcttatgtctttccctcagtcagcacctcatggtgtagtcttcttgcatgtgacatatgtccctgcacaagaaaagaacttcacaactgctcctgccatttgtcatgatggaaaagcacactttccacgtgaaggtgttttcgtttcaaatggcacacactggtttgttacacaaaggaatttttatgaaccacaaattattacaacagacaacacatttgtctctggtagctgtgatgttgtaataggaattgtcaacaacacagtttatgatcctttgcaaccagaacttgattcattcaaggaggagttggataaatactttaaaaatcatacatcacctgatgtagatttaggtgacatttctggcattaatgcttcagttgtcaatattcaaaaggaaattgaccgcctcaatgaggttgccaaaaatctaaatgaatctctcatcgatctccaagaacttggaaagtatgaacagtatataaaatggccatggtacatttggctaggttttatagctggcttgattgccataataatggtcacgattatgctttgctgtatgaccagttgctgcagttgtctcaagggctgttgttcttgcggatcttgctgcaaatttgatgaagacgactctgagccagtgctcaaaggagtcaaattacattacacataa

SEQ ID NO: 119 - RNA, 3822 nt, synthetic construct
  misc_feature 1..3822: note = SARS-CoV-2/Wuhan/HBCDC-HB-01/2019__EPI_ISL_402132 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctatcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 120 - RNA, 3822 nt, synthetic construct
  misc_feature 1..3822: note = SARS-CoV-2/Guangdong/20SF014/2020__EPI_ISL_403934 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggcatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 121 - RNA, 3822 nt, synthetic construct
  misc_feature 1..3822: note = SARS-CoV-2/Guangdong/20SF028/2020__EPI_ISL_403936 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttatattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 122 - RNA, 3822 nt, synthetic construct; identical to SEQ ID NO: 121
  misc_feature 1..3822: note = SARS-CoV-2/Guangdong/20SF040/2020__EPI_ISL_403937 spike protein CDS wt (1-1273)
  source 1..3822: mol_type = other RNA

SEQ ID NO: 123 - RNA, 3822 nt, synthetic construct
  misc_feature 1..3822: note = SARS-CoV-2/USA/IL1/2020__EPI_ISL_404253 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaayaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 124 - RNA, 3822 nt, synthetic construct
  misc_feature 1..3822: note = SARS-CoV-2/USA/CA1/2020__EPI_ISL_406034 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaataaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 125 - RNA, 3822 nt, synthetic construct; identical to SEQ ID NO: 121
  misc_feature 1..3822: note = SARS-CoV-2/Guangdong/20SF174/2020__EPI_ISL_406531 spike protein CDS wt (1-1273)
  source 1..3822: mol_type = other RNA

SEQ ID NO: 126 - RNA, 3822 nt, synthetic construct
  misc_feature 1..3822: note = SARS-CoV-2/Shenzhen/SZTH-001/2020__EPI_ISL_406592 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttctaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgggccagtgctcaaaggagtcaaattacattacacataa

SEQ ID NO: 127 - RNA, 3822 nt, synthetic construct
  misc_feature 1..3822: note = SARS-CoV-2/Shenzhen/SZTH-004/2020__EPI_ISL_406595 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttgggacaggaagagaatcagcaactgtgttgcttattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggcatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 128 - RNA, 3822 nt, synthetic construct
  misc_feature 1..3822: note = SARS-CoV-2/France/IDF0372/2020__EPI_ISL_406596 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctttcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 129 - RNA, 3822 nt, synthetic construct; identical to SEQ ID NO: 128
  misc_feature 1..3822: note = SARS-CoV-2/France/IDF0373/2020__EPI_ISL_406597 spike protein CDS wt (1-1273)
  source 1..3822: mol_type = other RNA

SEQ ID NO: 130 - RNA, 3822 nt, synthetic construct
  misc_feature 1..3822: note = SARS-CoV-2/Australia/VIC01/2020__EPI_ISL_406844 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaaggtatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 131 - RNA, 3822 nt, synthetic construct
  misc_feature 1..3822: note = SARS-CoV-2/Germany/BavPat1/2020__EPI_ISL_406862 spike protein CDS wt (1-1273)
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 132 - RNA, 2046 nt, synthetic construct
  misc_feature 1..2046: note = SARS-CoV-2/Wuhan/WIV05/2019__EPI_ISL_402128 spike protein CDS wt (1-681)
  source 1..2046: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctccttaa

SEQ ID NO: 133 - RNA, 45 nt, synthetic construct
  misc_feature 1..45: note = SARS-CoV-2/Wuhan/WIV05/2019__EPI_ISL_402128 spike protein CDS wt (1-15)
  source 1..45: mol_type = other RNA
atgtttgtttttcttgttttattgccactagtctctagtcagtgt

SEQ ID NO: 134 - RNA, 1998 nt, synthetic construct
  misc_feature 1..1998: note = SARS-CoV-2/Wuhan/WIV05/2019__EPI_ISL_402128 spike protein CDS wt (16-681)
  source 1..1998: mol_type = other RNA
gttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcct

SEQ ID NO: 135 - RNA, 1776 nt, synthetic construct
  misc_feature 1..1776: note = SARS-CoV-2/Wuhan/WIV05/2019__EPI_ISL_402128 spike protein CDS wt (682-1273)
  source 1..1776: mol_type = other RNA
cggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacaca

SEQ ID NO: 136 - RNA, 3822 nt, synthetic construct
  misc_feature 1..3822: note = SARS-CoV-2/Wuhan/WIV05/2019__EPI_ISL_402128 spike protein CDS gc (1-1273)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 137 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 138 - RNA, 2046 nt, synthetic construct
  misc_feature 1..2046: note = SARS-CoV-2/Wuhan/WIV05/2019__EPI_ISL_402128 spike protein CDS gc (1-681)
  source 1..2046: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgtga

SEQ ID NO: 139 - RNA, 45 nt, synthetic construct
  misc_feature 1..45: note = SARS-CoV-2/Wuhan/WIV05/2019__EPI_ISL_402128 spike protein CDS gc (1-15)
  source 1..45: mol_type = other RNA
atgttcgtgttcctggtcctcctgcccctggtgagctcccagtgc

SEQ ID NO: 140 - RNA, 1998 nt, synthetic construct
  misc_feature 1..1998: note = SARS-CoV-2/Wuhan/WIV05/2019__EPI_ISL_402128 spike protein CDS gc (16-681)
  source 1..1998: mol_type = other RNA
gtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccg

SEQ ID NO: 141 - RNA, 1776 nt, synthetic construct
  misc_feature 1..1776: note = SARS-CoV-2/Wuhan/WIV05/2019__EPI_ISL_402128 spike protein CDS gc (682-1273)
  source 1..1776: mol_type = other RNA
cggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacg

SEQ ID NO: 142 - RNA, 3822 nt, synthetic construct
  misc_feature 1..3822: note = SARS-CoV-2/Wuhan/WIV05/2019__EPI_ISL_402128 spike protein CDS human (1-1273)(K986P_V987P)
  source 1..3822: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacccgcccgaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactacacatga

SEQ ID NO: 143 - RNA, 2046 nt, synthetic construct
  misc_feature 1..2046: note = SARS-CoV-2/Wuhan/WIV05/2019__EPI_ISL_402128 spike protein CDS human (1-681)
  source 1..2046: mol_type = other RNA
atgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctccttga

SEQ ID NO: 144 - RNA, 45 nt, synthetic construct
  misc_feature 1..45: note = SARS-CoV-2/Wuhan/WIV05/2019__EPI_ISL_402128 spike protein CDS human (1-15)
  source 1..45: mol_type = other RNA
atgttcgtgtttctggtcctccttcccctggttagctcccagtgc

SEQ ID NO: 145 - RNA, 1998 nt, synthetic construct
  misc_feature 1..1998: note = SARS-CoV-2/Wuhan/WIV05/2019__EPI_ISL_402128 spike protein CDS human (16-681)
  source 1..1998: mol_type = other RNA
gtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcct

SEQ ID NO: 146 - RNA, 3822 nt, synthetic construct
  misc_feature 1..3822: note = SARS-CoV-2/Wuhan/WIV05/2019__EPI_ISL_402128 spike protein CDS gc mod (1-1273)(K986P_V987P)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 147 - RNA, 2046 nt, synthetic construct
  misc_feature 1..2046: note = SARS-CoV-2/Wuhan/WIV05/2019__EPI_ISL_402128 spike protein CDS gc mod (1-681)
  source 1..2046: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagcccctga

SEQ ID NO: 148 - RNA, 4094 nt, synthetic construct
  misc_feature 1..4094: note = SARS-CoV-2/Wuhan/WIV05/2019__EPI_ISL_402128 spike protein mRNA gc (1-1273) R9488, R9492, R10161
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 149 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P) R9487, R9491, R9709, R10159, R10160
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 150 - RNA, 4094 nt, synthetic construct
  misc_feature 1..4094: note = SARS-CoV-2/Wuhan/WIV05/2019__EPI_ISL_402128 spike protein mRNA human (1-1273)(K986P_V987P) R9486, R9490
  source 1..4094: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacccgcccgaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 151 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P) R10162
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 152 - RNA, 2318 nt, synthetic construct
  misc_feature 1..2318: note = SARS-CoV-2/Wuhan/WIV05/2019__EPI_ISL_402128 spike protein mRNA gc (1-681) R9489, R9493
  source 1..2318: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 153 - RNA, 2318 nt, synthetic construct
  misc_feature 1..2318: note = SARS-CoV-2/Wuhan/WIV05/2019__EPI_ISL_402128 spike protein mRNA human (1-681)
  source 1..2318: mol_type = other RNA
aggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctccttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 154 - RNA, 2318 nt, synthetic construct
  misc_feature 1..2318: note = SARS-CoV-2/Wuhan/WIV05/2019__EPI_ISL_402128 spike protein mRNA gc mod (1-681)
  source 1..2318: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagcccctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 155 - RNA, 4094 nt, synthetic construct
  misc_feature 1..4094: note = SARS-CoV-2/Wuhan/WIV05/2019__EPI_ISL_402128 spike protein mRNA gc (1-1273)
  source 1..4094: mol_type = other RNA
gggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 156 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P)
  source 1..4094: mol_type = other RNA
gggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 157 - RNA, 4094 nt, synthetic construct
  misc_feature 1..4094: note = SARS-CoV-2/Wuhan/WIV05/2019__EPI_ISL_402128 spike protein mRNA human (1-1273)(K986P_V987P)
  source 1..4094: mol_type = other RNA
gggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacccgcccgaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactacacatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 158 - RNA, 4094 nt, synthetic construct
  misc_feature 1..4094: note = SARS-CoV-2/Wuhan/WIV05/2019__EPI_ISL_402128 spike protein mRNA gc mod (1-1273)(K986P_V987P)
  source 1..4094: mol_type = other RNA
gggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 159 - RNA, 2318 nt, synthetic construct
  misc_feature 1..2318: note = SARS-CoV-2/Wuhan/WIV05/2019__EPI_ISL_402128 spike protein mRNA gc (1-681)
  source 1..2318: mol_type = other RNA
gggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 160 - RNA, 2318 nt, synthetic construct
  misc_feature 1..2318: note = SARS-CoV-2/Wuhan/WIV05/2019__EPI_ISL_402128 spike protein mRNA human (1-681)
  source 1..2318: mol_type = other RNA
gggagagtcccgcagtcggcgtccagcggctctgcttgttcgtgtgtgtgtcgttgcaggccttattcaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctccttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 161 - RNA, 2318 nt, synthetic construct
  misc_feature 1..2318: note = SARS-CoV-2/Wuhan/WIV05/2019__EPI_ISL_402128 spike protein mRNA gc mod (1-681)
  source 1..2318: mol_type = other RNA
gggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagcccctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 162 - RNA, 4039 nt, synthetic construct
  misc_feature 1..4039: note = SARS-CoV-2/Wuhan/WIV05/2019__EPI_ISL_402128 spike protein mRNA gc (1-1273) R9514
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 163 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P) R9515, R10157
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 164 - RNA, 4039 nt, synthetic construct
  misc_feature 1..4039: note = SARS-CoV-2/Wuhan/WIV05/2019__EPI_ISL_402128 spike protein mRNA human (1-1273)(K986P_V987P) R9517
  source 1..4039: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacccgcccgaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 165 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P) R9519
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 166 - RNA, 2263 nt, synthetic construct
  misc_feature 1..2263: note = SARS-CoV-2/Wuhan/WIV05/2019__EPI_ISL_402128 spike protein mRNA gc (1-681) R9506, R9513
  source 1..2263: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 167 - RNA, 2263 nt, synthetic construct
  misc_feature 1..2263: note = SARS-CoV-2/Wuhan/WIV05/2019__EPI_ISL_402128 spike protein mRNA human (1-681) R9516
  source 1..2263: mol_type = other RNA
aggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctccttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 168 - RNA, 2263 nt, synthetic construct
  misc_feature 1..2263: note = SARS-CoV-2/Wuhan/WIV05/2019__EPI_ISL_402128 spike protein mRNA gc mod (1-681) R9518
  source 1..2263: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagcccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 169 - RNA, 4039 nt, synthetic construct
  misc_feature 1..4039: note = SARS-CoV-2/Wuhan/WIV05/2019__EPI_ISL_402128 spike protein mRNA gc (1-1273)
  source 1..4039: mol_type = other RNA
gggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 170 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P)
  source 1..4039: mol_type = other RNA
gggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 171 - RNA, 4039 nt, synthetic construct
  misc_feature 1..4039: note = SARS-CoV-2/Wuhan/WIV05/2019__EPI_ISL_402128 spike protein mRNA human (1-1273)(K986P_V987P)
  source 1..4039: mol_type = other RNA
gggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctcctaggcgggcccgcagcgtcgcttcccagtcaataatcgcctacaccatgagcctgggggcagaaaattctgtggcctactccaacaatagtattgctatcccaacaaacttcactatcagcgttaccacagaaattcttcccgtgtctatgactaagacctccgtcgattgtacgatgtatatatgcggcgactcaacagagtgtagtaatctgttgctccaatacggcagcttttgcacccagctgaacagagccttaactggaatcgcagtggagcaggataaaaatacacaggaagttttcgcgcaagtgaagcagatttataaaaccccgcctatcaaggactttgggggattcaacttttcgcagattctgccagatccctccaaaccttctaagaggagcttcatcgaggacctactctttaataaggtaactctggctgatgccggtttcataaaacaatacggcgactgtcttggggatatcgcagcccgtgacttgatttgcgctcagaagttcaacggactgaccgtcctgcccccactcttaacagatgaaatgatcgcccagtatacgtcagcactgcttgctggcaccattacgagtggttggacatttggggccggcgcggccttgcagatccctttcgctatgcaaatggcataccggtttaatggaataggcgtgacccagaacgtgctctatgagaatcagaaactgattgccaaccagttcaactccgctatcgggaagattcaagactctctaagctccacagcctcagcactgggaaaactccaggacgtcgttaatcagaacgcgcaggccctgaatactcttgtgaagcaattgagcagtaactttggcgctatctcttccgtactgaatgatatattaagccgactcgacccgcccgaagccgaggtccagatcgatagactgattaccggtaggcttcagtcgctgcaaacgtacgtgacacagcagttgatccgcgcagctgagattcgggcctcagcaaacctcgccgctaccaaaatgtctgaatgcgttctggggcagagtaagagagtggacttctgtggaaaaggctaccacctaatgtcctttccccaaagcgcgccacatggtgtcgtgttcctgcacgttacttatgtgccggcccaggagaagaattttaccacagctcctgcaatctgccacgatggcaaagcccatttccccagggaaggggtctttgtatctaacggaactcactggttcgtgacccagcgcaatttttacgagccacagataattacaacggacaacaccttcgttagcggcaattgtgatgtggtcatcgggatcgtgaacaatactgtatatgaccccctccaacctgagctggattccttcaaggaggaacttgacaaatactttaagaaccatacatcaccagatgtggacttgggagatattagtggcatcaatgccagcgtcgttaacattcagaaggaaatagaccgactgaatgaggtggctaaaaacttaaacgaatctctcatcgacctgcaggagcttggtaagtatgagcagtacattaaatggccctggtatatctggctggggttcattgcaggactaatcgccatagtgatggtcaccatcatgctctgctgtatgacttcctgctgttcatgcctgaagggctgttgcagttgtggtagctgctgcaaatttgatgaagacgattccgagcctgtgttgaagggcgttaagctgcactacacatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 172 - RNA, 4039 nt, synthetic construct
  misc_feature 1..4039: note = SARS-CoV-2/Wuhan/WIV05/2019__EPI_ISL_402128 spike protein mRNA gc mod (1-1273)(K986P_V987P)
  source 1..4039: mol_type = other RNA
gggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 173 - RNA, 2263 nt, synthetic construct
  misc_feature 1..2263: note = SARS-CoV-2/Wuhan/WIV05/2019__EPI_ISL_402128 spike protein mRNA gc (1-681)
  source 1..2263: mol_type = other RNA
gggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 174 - RNA, 2263 nt, synthetic construct
  misc_feature 1..2263: note = SARS-CoV-2/Wuhan/WIV05/2019__EPI_ISL_402128 spike protein mRNA human (1-681)
  source 1..2263: mol_type = other RNA
gggagaaagcttaccatgttcgtgtttctggtcctccttcccctggttagctcccagtgcgtgaacttgaccacaagaactcaattacctccagcctacactaattctttcaccaggggcgtatattacccggacaaggtgtttcggtcaagtgtcctgcacagcacacaggatctattcctcccctttttctccaacgtgacttggtttcatgctatccacgtttctgggaccaatggaacaaaacgcttcgacaaccctgtgctgccatttaatgatggtgtctatttcgcatcgaccgagaagtcaaacattatacgaggctggatctttgggactacacttgacagcaaaacccagagtctgttgattgtgaataacgccacgaatgtagttatcaaggtgtgtgagttccagttttgcaacgatcccttcctcggagtctactatcataaaaataacaagtcctggatggagtctgagttccgtgtgtacagctccgcgaataactgtacttttgaatatgtgtcacaacctttcctgatggacctggaaggcaagcagggtaattttaaaaacctcagagagttcgtctttaagaacattgatgggtacttcaaaatctacagtaagcacaccccaataaatttagttagggacctgccccagggatttagcgctcttgagcctttggtggatctgccaatcggcattaacatcacacggttccagactctactcgccctgcatcgctcttatcttaccccgggcgactcctcaagcgggtggacagcaggagccgctgcatactatgtaggttacctgcaacccagaacctttttgctcaaatataatgaaaacggcacgattactgatgccgtggactgcgctctggatcctttaagtgagacaaagtgtaccctgaagtctttcactgtcgaaaaagggatctaccagacatccaattttagggtgcagccaaccgagagcatagttcggttccccaacattacgaatctctgcccttttggagaggtgttcaacgccacccgcttcgcgtcggtctatgcatggaatcgaaagagaatctctaactgtgtggccgactactccgtactttacaattcagctagttttagcacattcaaatgctatggcgtttccccaactaagctgaacgacttgtgttttaccaatgtgtacgccgattctttcgtcattaggggtgacgaagtgcggcagatcgcacccgggcaaacaggaaaaatcgctgattataactacaagctaccggacgattttactggctgcgtcattgcctggaatagcaacaacctggactcaaaagtgggcgggaattataactacctctatcgtctgttccgcaagagtaatcttaagccttttgagagagatatatccaccgaaatctaccaggcgggaagcacaccctgtaacggtgttgagggcttcaattgctactttccactgcagtcttatgggttccaacctaccaacggagtgggctaccagccctatagggtagtcgtgttgtcatttgaactcctgcacgccccagcaactgtttgcggtcccaaaaagagtacgaatttagtgaaaaacaagtgtgtcaatttcaactttaatgggctgacaggcaccggagtgctaactgagagcaacaaaaagttcctccctttccagcagtttggccgggacattgctgataccacagacgccgtacgagatccacaaaccctggagatccttgacataactccgtgctccttcgggggagtgtctgttattacacccggtacgaatacctcgaaccaggtcgctgtgttgtaccaggacgtgaattgtactgaagtccctgttgccatccacgcagatcagctgacaccaacctggcgcgtgtatagcacaggctccaacgtgtttcaaactagagccgggtgcctcatcggagctgagcatgtaaacaattcatacgaatgtgacattcccatcggcgcgggtatttgcgcaagttatcagacccagacgaactctccttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 175 - RNA, 2263 nt, synthetic construct
  misc_feature 1..2263: note = SARS-CoV-2/Wuhan/WIV05/2019__EPI_ISL_402128 spike protein mRNA gc mod (1-681)
  source 1..2263: mol_type = other RNA
gggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagcccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 176-177 - skipped (2 entries)

SEQ ID NO: 178 - DNA, 24 bp, synthetic construct
  misc_feature 1..24: note = histone stem-loop (histoneSL,hSL)
  source 1..24: mol_type = other DNA
caaaggctcttttcagagccacca

SEQ ID NO: 179 - RNA, 24 nt, synthetic construct
  misc_feature 1..24: note = histone stem-loop (histoneSL,hSL) mRNA
  source 1..24: mol_type = other RNA
caaaggctcttttcagagccacca

SEQ ID NO: 180 - DNA, 13 bp, synthetic construct
  misc_feature 1..13: note = Kozak
  source 1..13: mol_type = other DNA
gccgccaccatgg

SEQ ID NO: 181 - RNA, 13 nt, synthetic construct
  misc_feature 1..13: note = Kozak mRNA
  source 1..13: mol_type = other RNA
gccgccaccatgg

SEQ ID NO: 182 - RNA, 128 nt, synthetic construct
  misc_feature 1..128: note = mRNA 3'-end A64-N5-C30-histoneSL-N5
  source 1..128: mol_type = other RNA
aaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 183 - RNA, 129 nt, synthetic construct
  misc_feature 1..129: note = mRNA 3'-end histoneSL-A100-N5
  source 1..129: mol_type = other RNA
caaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaatt

SEQ ID NO: 184 - RNA, 93 nt, synthetic construct
  misc_feature 1..93: note = mRNA 3'-end histoneSL-A64-N5
  source 1..93: mol_type = other RNA
caaaggctcttttcagagccaccaaaaaaaaaaaaaaaaaaaaaaaaaaaaaaaaaaaaaaaaaaaaaaaaaaaaaaaaaaaaaaaaagaatt

SEQ ID NO: 185 - RNA, 105 nt, synthetic construct
  misc_feature 1..105: note = mRNA 3'-end A100-N5
  source 1..105: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaatt

SEQ ID NO: 186 - RNA, 69 nt, synthetic construct
  misc_feature 1..69: note = mRNA 3'-end A64-N5
  source 1..69: mol_type = other RNA
aaaaaaaaaaaaaaaaaaaaaaaaaaaaaaaaaaaaaaaaaaaaaaaaaaaaaaaaaaaaaaaagaatt

SEQ ID NO: 187 - RNA, 124 nt, synthetic construct
  misc_feature 1..124: note = mRNA 3'-end histoneSL-A100
  source 1..124: mol_type = other RNA
caaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 188 - RNA, 88 nt, synthetic construct
  misc_feature 1..88: note = mRNA 3'-end histoneSL-A64
  source 1..88: mol_type = other RNA
caaaggctcttttcagagccaccaaaaaaaaaaaaaaaaaaaaaaaaaaaaaaaaaaaaaaaaaaaaaaaaaaaaaaaaaaaaaaaaa

SEQ ID NO: 189 - RNA, 100 nt, synthetic construct
  misc_feature 1..100: note = mRNA 3'-end A100
  source 1..100: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 190 - RNA, 64 nt, synthetic construct
  misc_feature 1..64: note = mRNA 3'-end A64
  source 1..64: mol_type = other RNA
aaaaaaaaaaaaaaaaaaaaaaaaaaaaaaaaaaaaaaaaaaaaaaaaaaaaaaaaaaaaaaaa

SEQ ID NO: 191 - RNA, 93 nt, synthetic construct
  misc_feature 1..93: note = mRNA 3'-end A64-histoneSL-N5
  source 1..93: mol_type = other RNA
aaaaaaaaaaaaaaaaaaaaaaaaaaaaaaaaaaaaaaaaaaaaaaaaaaaaaaaaaaaaaaaacaaaggctcttttcagagccaccagaatt

SEQ ID NO: 192 - RNA, 134 nt, synthetic construct
  misc_feature 1..134: note = mRNA 3'-end N6-A64-N5-C30-histoneSL-N5
  source 1..134: mol_type = other RNA
attaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 193 - RNA, 134 nt, synthetic construct
  misc_feature 1..134: note = mRNA 3'-end N6-A64-N5-C30-histoneSL-N5
  source 1..134: mol_type = other RNA
agatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 194 - RNA, 135 nt, synthetic construct
  misc_feature 1..135: note = mRNA 3'-end N6-histoneSL-A100-N5
  source 1..135: mol_type = other RNA
attaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaatt

SEQ ID NO: 195 - RNA, 135 nt, synthetic construct
  misc_feature 1..135: note = mRNA 3'-end N6-histoneSL-A100-N5
  source 1..135: mol_type = other RNA
agatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaatt

SEQ ID NO: 196 - RNA, 99 nt, synthetic construct
  misc_feature 1..99: note = mRNA 3'-end N6-histoneSL-A64-N5
  source 1..99: mol_type = other RNA
attaatcaaaggctcttttcagagccaccaaaaaaaaaaaaaaaaaaaaaaaaaaaaaaaaaaaaaaaaaaaaaaaaaaaaaaaaaaaaaaaaagaatt

SEQ ID NO: 197 - RNA, 99 nt, synthetic construct
  misc_feature 1..99: note = mRNA 3'-end N6-histoneSL-A64-N5
  source 1..99: mol_type = other RNA
agatctcaaaggctcttttcagagccaccaaaaaaaaaaaaaaaaaaaaaaaaaaaaaaaaaaaaaaaaaaaaaaaaaaaaaaaaaaaaaaaaagaatt

SEQ ID NO: 198 - RNA, 111 nt, synthetic construct
  misc_feature 1..111: note = mRNA 3'-end N6-A100-N5
  source 1..111: mol_type = other RNA
attaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaatt

SEQ ID NO: 199 - RNA, 111 nt, synthetic construct
  misc_feature 1..111: note = mRNA 3'-end N6-A100-N5
  source 1..111: mol_type = other RNA
agatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaatt

SEQ ID NO: 200 - RNA, 75 nt, synthetic construct
  misc_feature 1..75: note = mRNA 3'-end N6-A64-N5
  source 1..75: mol_type = other RNA
attaataaaaaaaaaaaaaaaaaaaaaaaaaaaaaaaaaaaaaaaaaaaaaaaaaaaaaaaaaaaaaaaagaatt

SEQ ID NO: 201 - RNA, 75 nt, synthetic construct
  misc_feature 1..75: note = mRNA 3'-end N6-A64-N5
  source 1..75: mol_type = other RNA
agatctaaaaaaaaaaaaaaaaaaaaaaaaaaaaaaaaaaaaaaaaaaaaaaaaaaaaaaaaaaaaaaaagaatt

SEQ ID NO: 202 - RNA, 130 nt, synthetic construct
  misc_feature 1..130: note = mRNA 3'-end N6-histoneSL-A100
  source 1..130: mol_type = other RNA
attaatcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 203 - RNA, 130 nt, synthetic construct
  misc_feature 1..130: note = mRNA 3'-end N6-histoneSL-A100
  source 1..130: mol_type = other RNA
agatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 204 - RNA, 94 nt, synthetic construct
  misc_feature 1..94: note = mRNA 3'-end N6-histoneSL-A64
  source 1..94: mol_type = other RNA
attaatcaaaggctcttttcagagccaccaaaaaaaaaaaaaaaaaaaaaaaaaaaaaaaaaaaaaaaaaaaaaaaaaaaaaaaaaaaaaaaaa

SEQ ID NO: 205 - RNA, 94 nt, synthetic construct
  misc_feature 1..94: note = mRNA 3'-end N6-histoneSL-A64
  source 1..94: mol_type = other RNA
agatctcaaaggctcttttcagagccaccaaaaaaaaaaaaaaaaaaaaaaaaaaaaaaaaaaaaaaaaaaaaaaaaaaaaaaaaaaaaaaaaa

SEQ ID NO: 206 - RNA, 106 nt, synthetic construct
  misc_feature 1..106: note = mRNA 3'-end N6-A100
  source 1..106: mol_type = other RNA
attaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 207 - RNA, 106 nt, synthetic construct
  misc_feature 1..106: note = mRNA 3'-end N6-A100
  source 1..106: mol_type = other RNA
agatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 208 - RNA, 70 nt, synthetic construct
  misc_feature 1..70: note = mRNA 3'-end N6-A64
  source 1..70: mol_type = other RNA
attaataaaaaaaaaaaaaaaaaaaaaaaaaaaaaaaaaaaaaaaaaaaaaaaaaaaaaaaaaaaaaaaa

SEQ ID NO: 209 - RNA, 70 nt, synthetic construct
  misc_feature 1..70: note = mRNA 3'-end N6-A64
  source 1..70: mol_type = other RNA
agatctaaaaaaaaaaaaaaaaaaaaaaaaaaaaaaaaaaaaaaaaaaaaaaaaaaaaaaaaaaaaaaaa

SEQ ID NO: 210 - RNA, 99 nt, synthetic construct
  misc_feature 1..99: note = mRNA 3'-end N6-A64-histoneSL-N5
  source 1..99: mol_type = other RNA
attaataaaaaaaaaaaaaaaaaaaaaaaaaaaaaaaaaaaaaaaaaaaaaaaaaaaaaaaaaaaaaaaacaaaggctcttttcagagccaccagaatt

SEQ ID NO: 211 - RNA, 99 nt, synthetic construct
  misc_feature 1..99: note = mRNA 3'-end N6-A64-histoneSL-N5
  source 1..99: mol_type = other RNA
agatctaaaaaaaaaaaaaaaaaaaaaaaaaaaaaaaaaaaaaaaaaaaaaaaaaaaaaaaaaaaaaaaacaaaggctcttttcagagccaccagaatt

SEQ ID NO: 212 - RNA, 110 nt, synthetic construct
  misc_feature 1..110: note = mRNA 3'-end N12-A64-N5-histoneSL-N5
  source 1..110: mol_type = other RNA
attaatagatctaaaaaaaaaaaaaaaaaaaaaaaaaaaaaaaaaaaaaaaaaaaaaaaaaaaaaaaaaaaaaaaatgcatcaaaggctcttttcagagccaccagaatt

SEQ ID NO: 213 - RNA, 110 nt, synthetic construct; identical to SEQ ID NO: 212
  misc_feature 1..110: note = mRNA 3'-end N12-A64-N5-histoneSL-N5
  source 1..110: mol_type = other RNA

SEQ ID NO: 214 - RNA, 99 nt, synthetic construct
  misc_feature 1..99: note = mRNA 3'-end A75-histoneSL
  source 1..99: mol_type = other RNA
aaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 215 - RNA, 102 nt, synthetic construct
  misc_feature 1..102: note = mRNA 3'-end U3-A75-histoneSL
  source 1..102: mol_type = other RNA
tttaaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 216 - RNA, 178 nt, synthetic construct
  misc_feature 1..178: note = mRNA 3'-end A154-histoneSL
  source 1..178: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 217 - RNA, 181 nt, synthetic construct
  misc_feature 1..181: note = mRNA 3'-end U3-A154-histoneSL
  source 1..181: mol_type = other RNA
tttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 218 - RNA, 101 nt, synthetic construct
  misc_feature 1..101: note = mRNA 3'-end N2-A75-histoneSL
  source 1..101: mol_type = other RNA
agaaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 219 - RNA, 99 nt, synthetic construct
  misc_feature 1..99: note = mRNA 3'-end histoneSL-A75
  source 1..99: mol_type = other RNA
caaaggctcttttcagagccaccaaaaaaaaaaaaaaaaaaaaaaaaaaaaaaaaaaaaaaaaaaaaaaaaaaaaaaaaaaaaaaaaaaaaaaaaaaaa

SEQ ID NO: 220 - RNA, 170 nt, synthetic construct
  misc_feature 1..170: note = mRNA 3'-end histoneSL-A146
  source 1..170: mol_type = other RNA
caaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 221 - RNA, 136 nt, synthetic construct
  misc_feature 1..136: note = mRNA 3'-end N8-A64-N5-C30-histoneSL-N5
  source 1..136: mol_type = other RNA
agattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 222 - RNA, 131 nt, synthetic construct
  misc_feature 1..131: note = mRNA 3'-end N8-A64-N5-C30-histoneSL
  source 1..131: mol_type = other RNA
agattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccacca

SEQ ID NO: 223 - RNA, 105 nt, synthetic construct
  misc_feature 1..105: note = mRNA 3'-end N8-A64-N5-C4-histoneSL
  source 1..105: mol_type = other RNA
agattaataaaaaaaaaaaaaaaaaaaaaaaaaaaaaaaaaaaaaaaaaaaaaaaaaaaaaaaaaaaaaaaatgcatcccccaaaggctcttttcagagccacca

SEQ ID NO: 224 - RNA, 115 nt, synthetic construct
  misc_feature 1..115: note = mRNA 3'-end N8-A64-N5-C14-histoneSL
  source 1..115: mol_type = other RNA
agattaataaaaaaaaaaaaaaaaaaaaaaaaaaaaaaaaaaaaaaaaaaaaaaaaaaaaaaaaaaaaaaaatgcatcccccccccccccccaaaggctcttttcagagccacca

SEQ ID NO: 225 - RNA, 129 nt, synthetic construct
  misc_feature 1..129: note = mRNA 3'-end N6-A64-N5-C30-histoneSL
  source 1..129: mol_type = other RNA
agatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccacca

SEQ ID NO: 226 - RNA, 103 nt, synthetic construct
  misc_feature 1..103: note = mRNA 3'-end N6-A64-N5-C4-histoneSL
  source 1..103: mol_type = other RNA
agatctaaaaaaaaaaaaaaaaaaaaaaaaaaaaaaaaaaaaaaaaaaaaaaaaaaaaaaaaaaaaaaaatgcatcccccaaaggctcttttcagagccacca

SEQ ID NO: 227 - RNA, 113 nt, synthetic construct
  misc_feature 1..113: note = mRNA 3'-end N6-A64-N5-C14-histoneSL
  source 1..113: mol_type = other RNA
agatctaaaaaaaaaaaaaaaaaaaaaaaaaaaaaaaaaaaaaaaaaaaaaaaaaaaaaaaaaaaaaaaatgcatcccccccccccccccaaaggctcttttcagagccacca

SEQ ID NO: 228 - RNA, 123 nt, synthetic construct
  misc_feature 1..123: note = mRNA 3'-end A64-N5-C30-histoneSL
  source 1..123: mol_type = other RNA
aaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccacca

SEQ ID NO: 229 - RNA, 97 nt, synthetic construct
  misc_feature 1..97: note = mRNA 3'-end A64-N5-C4-histoneSL
  source 1..97: mol_type = other RNA
aaaaaaaaaaaaaaaaaaaaaaaaaaaaaaaaaaaaaaaaaaaaaaaaaaaaaaaaaaaaaaaatgcatcccccaaaggctcttttcagagccacca

SEQ ID NO: 230 - RNA, 107 nt, synthetic construct
  misc_feature 1..107: note = mRNA 3'-end A64-N5-C14-histoneSL
  source 1..107: mol_type = other RNA
aaaaaaaaaaaaaaaaaaaaaaaaaaaaaaaaaaaaaaaaaaaaaaaaaaaaaaaaaaaaaaaatgcatcccccccccccccccaaaggctcttttcagagccacca

SEQ ID NO: 231 - DNA, 62 bp, synthetic construct
  misc_feature 1..62: note = HSD17B4 5'-UTR
  source 1..62: mol_type = other DNA
gtcccgcagtcggcgtccagcggctctgcttgttcgtgtgtgtgtcgttgcaggccttattc

SEQ ID NO: 232 - RNA, 62 nt, synthetic construct
  misc_feature 1..62: note = HSD17B4 5'-UTR
  source 1..62: mol_type = other RNA
gtcccgcagtcggcgtccagcggctctgcttgttcgtgtgtgtgtcgttgcaggccttattc

SEQ ID NO: 233 - DNA, 42 bp, synthetic construct
  misc_feature 1..42: note = ASAH1 5'-UTR
  source 1..42: mol_type = other DNA
gcctctgctggagtccggggagtggcgttggctgctagagcg

SEQ ID NO: 234 - RNA, 42 nt, synthetic construct
  misc_feature 1..42: note = ASAH1 5'-UTR
  source 1..42: mol_type = other RNA
gcctctgctggagtccggggagtggcgttggctgctagagcg

SEQ ID NO: 235 - DNA, 75 bp, synthetic construct
  misc_feature 1..75: note = ATP5A1 5'-UTR
  source 1..75: mol_type = other DNA
gcggctcggccattttgtcccagtcagtccggaggctgcggctgcagaagtaccgcctgcggagtaactgcaaag

SEQ ID NO: 236 - RNA, 75 nt, synthetic construct
  misc_feature 1..75: note = ATP5A1 5'-UTR
  source 1..75: mol_type = other RNA
gcggctcggccattttgtcccagtcagtccggaggctgcggctgcagaagtaccgcctgcggagtaactgcaaag

SEQ ID NO: 237 - DNA, 54 bp, synthetic construct
  misc_feature 1..54: note = Mp68_(2010107E04Rik) 5'-UTR
  source 1..54: mol_type = other DNA
ctttcccattctgtagcagaatttggtgttgcctgtggtcttggtcccgcggag

SEQ ID NO: 238 - RNA, 54 nt, synthetic construct
  misc_feature 1..54: note = Mp68_(2010107E04Rik) 5'-UTR
  source 1..54: mol_type = other RNA
ctttcccattctgtagcagaatttggtgttgcctgtggtcttggtcccgcggag

SEQ ID NO: 239 - DNA, 81 bp, synthetic construct
  misc_feature 1..81: note = Ndufa4 5'-UTR
  source 1..81: mol_type = other DNA
gtccgctcagccaggttgcagaagcggcttagcgtgtgtcctaatcttctctctgcgtgtaggtaggcctgtgccgcaaac

SEQ ID NO: 240 - RNA, 81 nt, synthetic construct
  misc_feature 1..81: note = Ndufa4 5'-UTR
  source 1..81: mol_type = other RNA
gtccgctcagccaggttgcagaagcggcttagcgtgtgtcctaatcttctctctgcgtgtaggtaggcctgtgccgcaaac

SEQ ID NO: 241 - DNA, 108 bp, synthetic construct
  misc_feature 1..108: note = Nosip 5'-UTR
  source 1..108: mol_type = other DNA
ctcctgtcgggcggaagtaggaggagtagagtttaaaaacagtactctttttccggttcgggacgtagttgaagcaacgacaagccggataaccgctcttgagacagg

SEQ ID NO: 242 - RNA, 108 nt, synthetic construct
  misc_feature 1..108: note = Nosip 5'-UTR
  source 1..108: mol_type = other RNA
ctcctgtcgggcggaagtaggaggagtagagtttaaaaacagtactctttttccggttcgggacgtagttgaagcaacgacaagccggataaccgctcttgagacagg

SEQ ID NO: 243 - DNA, 84 bp, synthetic construct
  misc_feature 1..84: note = Rpl31 5'-UTR
  source 1..84: mol_type = other DNA
cccgtgacccggaagttgtacggctacgcgactttccctcccacaaaccctcgcgcccttcctttcctacttgggcccggcaga

SEQ ID NO: 244 - RNA, 84 nt, synthetic construct
  misc_feature 1..84: note = Rpl31 5'-UTR
  source 1..84: mol_type = other RNA
cccgtgacccggaagttgtacggctacgcgactttccctcccacaaaccctcgcgcccttcctttcctacttgggcccggcaga

SEQ ID NO: 245 - DNA, 159 bp, synthetic construct
  misc_feature 1..159: note = Slc7a3 5'-UTR
  source 1..159: mol_type = other DNA
gggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactaga

SEQ ID NO: 246 - RNA, 159 nt, synthetic construct
  misc_feature 1..159: note = Slc7a3 5'-UTR
  source 1..159: mol_type = other RNA
gggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactaga

SEQ ID NO: 247 - DNA, 102 bp, synthetic construct
  misc_feature 1..102: note = TUBB4B 5'-UTR
  source 1..102: mol_type = other DNA
atataagcgttggcggagcgtcggttgtagcactctgcgcgcccgctcttctgctgctgtttgtctacttcctcctgcttccccgccgccgccgccgccatc

SEQ ID NO: 248 - RNA, 102 nt, synthetic construct
  misc_feature 1..102: note = TUBB4B 5'-UTR
  source 1..102: mol_type = other RNA
atataagcgttggcggagcgtcggttgtagcactctgcgcgcccgctcttctgctgctgtttgtctacttcctcctgcttccccgccgccgccgccgccatc

SEQ ID NO: 249 - DNA, 222 bp, synthetic construct
  misc_feature 1..222: note = Ubqln2 5'-UTR
  source 1..222: mol_type = other DNA
cggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgcc

SEQ ID NO: 250 - RNA, 222 nt, synthetic construct
  misc_feature 1..222: note = Ubqln2 5'-UTR
  source 1..222: mol_type = other RNA
cggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgcc

SEQ ID NO: 251 - DNA, 42 bp, synthetic construct
  misc_feature 1..42: note = RPL32_(32L4,32L3) 5'-UTR
  source 1..42: mol_type = other DNA
ggcgctgcctacggaggtggcagccatctccttctcggcatc

SEQ ID NO: 252 - RNA, 42 nt, synthetic construct
  misc_feature 1..42: note = RPL32_(32L4,32L3) 5'-UTR
  source 1..42: mol_type = other RNA
ggcgctgcctacggaggtggcagccatctccttctcggcatc

SEQ ID NO: 253 - DNA, 57 bp, synthetic construct
  misc_feature 1..57: note = PSMB3 3'-UTR
  source 1..57: mol_type = other DNA
ccctgttcccagagcccacttttttttctttttttgaaataaaatagcctgtctttc

SEQ ID NO: 254 - RNA, 57 nt, synthetic construct
  misc_feature 1..57: note = PSMB3 3'-UTR
  source 1..57: mol_type = other RNA
ccctgttcccagagcccacttttttttctttttttgaaataaaatagcctgtctttc

SEQ ID NO: 255 - DNA, 121 bp, synthetic construct
  misc_feature 1..121: note = CASP1 3'-UTR
  source 1..121: mol_type = other DNA
aataaggaaactgtatgaatgtctgtgggcaggaagtgaagagatccttctgtaaaggtttttggaattatgtctgctgaataataaacttttttgaaataataaatctggtagaaaaatg

SEQ ID NO: 256 - RNA, 121 nt, synthetic construct
  misc_feature 1..121: note = CASP1 3'-UTR
  source 1..121: mol_type = other RNA
aataaggaaactgtatgaatgtctgtgggcaggaagtgaagagatccttctgtaaaggtttttggaattatgtctgctgaataataaacttttttgaaataataaatctggtagaaaaatg

SEQ ID NO: 257 - DNA, 137 bp, synthetic construct
  misc_feature 1..137: note = COX6B1 3'-UTR
  source 1..137: mol_type = other DNA
actggctgcatctccctttcctctgtcctccatccttctcccaggatggtgaagggggacctggtacccagtgatccccaccccaggatcctaaatcatgacttacctgctaataaaaactcattggaaaagtgaga

SEQ ID NO: 258 - RNA, 137 nt, synthetic construct
  misc_feature 1..137: note = COX6B1 3'-UTR
  source 1..137: mol_type = other RNA
actggctgcatctccctttcctctgtcctccatccttctcccaggatggtgaagggggacctggtacccagtgatccccaccccaggatcctaaatcatgacttacctgctaataaaaactcattggaaaagtgaga

SEQ ID NO: 259 - DNA, 353 bp, synthetic construct
  misc_feature 1..353: note = Gnas 3'-UTR
  source 1..353: mol_type = other DNA
gaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagca

SEQ ID NO: 260 - RNA, 353 nt, synthetic construct
  misc_feature 1..353: note = Gnas 3'-UTR
  source 1..353: mol_type = other RNA
gaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagca

SEQ ID NO: 261 - DNA, 133 bp, synthetic construct
  misc_feature 1..133: note = Ndufa1 3'-UTR
  source 1..133: mol_type = other DNA
ggaagcattttcctggctgattaaaagaaattactcagctatggtcatctgttcctgttagaaggctatgcagcatattatatactatgcgcatgttatgaaatgcataataaaaaattttaaaaaatctaaa

SEQ ID NO: 262 - RNA, 133 nt, synthetic construct
  misc_feature 1..133: note = Ndufa1 3'-UTR
  source 1..133: mol_type = other RNA
ggaagcattttcctggctgattaaaagaaattactcagctatggtcatctgttcctgttagaaggctatgcagcatattatatactatgcgcatgttatgaaatgcataataaaaaattttaaaaaatctaaa

SEQ ID NO: 263 - DNA, 70 bp, synthetic construct
  misc_feature 1..70: note = RPS9 3'-UTR
  source 1..70: mol_type = other DNA
gtccacctgtccctcctgggctgctggattgtctcgttttcctgccaaataaacaggatcagcgctttac

SEQ ID NO: 264 - RNA, 70 nt, synthetic construct
  misc_feature 1..70: note = RPS9 3'-UTR
  source 1..70: mol_type = other RNA
gtccacctgtccctcctgggctgctggattgtctcgttttcctgccaaataaacaggatcagcgctttac

SEQ ID NO: 265 - DNA, 187 bp, synthetic construct
  misc_feature 1..187: note = ALB7 3'-UTR
  source 1..187: mol_type = other DNA
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 266 - RNA, 187 nt, synthetic construct
  misc_feature 1..187: note = ALB7 3'-UTR
  source 1..187: mol_type = other RNA
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 267 - DNA, 44 bp, synthetic construct
  misc_feature 1..44: note = muag 3'-UTR
  source 1..44: mol_type = other DNA
gcccgatgggcctcccaacgggccctcctcccctccttgcaccg

SEQ ID NO: 268 - RNA, 44 nt, synthetic construct
  misc_feature 1..44: note = muag 3'-UTR
  source 1..44: mol_type = other RNA
gcccgatgggcctcccaacgggccctcctcccctccttgcaccg

SEQ ID NO: 269 - protein, 14 aa, synthetic construct
  REGION 1..14: note = carrier peptide CR12C
CRRRRRRRRRRRRC

SEQ ID NO: 270 - protein, 13 aa, synthetic construct
  REGION 1..13: note = carrier peptide CR12
CRRRRRRRRRRRR

SEQ ID NO: 271 - protein, 14 aa, synthetic construct
  REGION 1..14: note = carrier peptide WR12C
WRRRRRRRRRRRRC

SEQ ID NO: 272 - protein, 18 aa, synthetic construct
  REGION 1..18: note = carrier peptide CH6R4H6C
CHHHHHHRRRRHHHHHHC

SEQ ID NO: 273 - protein, 18 aa, synthetic construct
  REGION 1..18: note = carrier peptide CGH5R4H5GC
CGHHHHHRRRRHHHHHGC

SEQ ID NO: 274 - protein, 1273 aa, synthetic construct; identical to SEQ ID NO: 1
  REGION 1..1273: note = SARS-CoV-2/Wuhan/WIV05/2019__EPI_ISL_402128 spike protein (1-1273)

SEQ ID NO: 275 - protein, 1269 aa, synthetic construct; identical to SEQ ID NO: 2
  REGION 1..1269: note = SARS-CoV-2/bat/Yunnan/RaTG13/2013__EPI_ISL_402131 spike protein (1-1269)

SEQ ID NO: 276 - protein, 1273 aa, synthetic construct; identical to SEQ ID NO: 3
  REGION 1..1273: note = SARS-CoV-2/Wuhan/HBCDC-HB-01/2019__EPI_ISL_402132 spike protein (1-1273)

SEQ ID NO: 277 - protein, 1273 aa, synthetic construct; identical to SEQ ID NO: 4
  REGION 1..1273: note = SARS-CoV-2/Guangdong/20SF028/2020__EPI_ISL_403936 spike protein (1-1273)

SEQ ID NO: 278 - protein, 1273 aa, synthetic construct; identical to SEQ ID NO: 5
  REGION 1..1273: note = SARS-CoV-2/Shenzhen/SZTH-001/2020__EPI_ISL_406592 spike protein (1-1273)

SEQ ID NO: 279 - protein, 1273 aa, synthetic construct; identical to SEQ ID NO: 6
  REGION 1..1273: note = SARS-CoV-2/Shenzhen/SZTH-004/2020__EPI_ISL_406595 spike protein (1-1273)

SEQ ID NO: 280 - protein, 1273 aa, synthetic construct; identical to SEQ ID NO: 7
  REGION 1..1273: note = SARS-CoV-2/France/IDF0372/2020__EPI_ISL_406596 spike protein (1-1273)

SEQ ID NO: 281 - protein, 1273 aa, synthetic construct; identical to SEQ ID NO: 8
  REGION 1..1273: note = SARS-CoV-2/Australia/VIC01/2020__EPI_ISL_406844 spike protein (1-1273)

SEQ ID NO: 282 - protein, 1273 aa, synthetic construct; identical to SEQ ID NO: 9
  REGION 1..1273: note = SARS-CoV-2/Germany/BavPat1/2020__EPI_ISL_406862 spike protein (1-1273)

SEQ ID NO: 283 - protein, 1273 aa, synthetic construct
  REGION 1..1273: note = SARS-CoV-2/Wuhan/HBCDC-HB-02/2020__EPI_ISL_412978 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 284 - protein, 1273 aa, synthetic construct
  REGION 1..1273: note = SARS-CoV-2/Australia/QLD02/2020__EPI_ISL_407896 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 285 - protein, 1273 aa, synthetic construct
  REGION 1..1273: note = SARS-CoV-2/India/1-31/2020__EPI_ISL_413523 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 286 - protein, 1273 aa, synthetic construct
  REGION 1..1273: note SARS-CoV-2/Guangdong/GD2020087-P0008/2020__EPI_ISL_413863 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 287 - protein, 1273 aa, synthetic construct
  REGION 1..1273: note = SARS-CoV-2/Sweden/01/2020__EPI_ISL_411951 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 288 - protein, 1273 aa, synthetic construct
  REGION 1..1273: note = SARS-CoV-2/Tianmen/HBCDC-HB-07/2020__EPI_ISL_412983 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 289 - protein, 1273 aa, synthetic construct
  REGION 1..1273: note = SARS-CoV-2/Hong Kong/case42_VM20002493/2020__EPI_ISL_414527 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 290 - protein, 1273 aa, synthetic construct
  REGION 1..1273: note = SARS-CoV-2/USA/CruiseA-23/2020__EPI_ISL_414482 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 291 - protein, 1273 aa, synthetic construct
  REGION 1..1273: note = SARS-CoV-2/Hong Kong/case85_VM20002868/2020__EPI_ISL_414519 spike protein (1-1273)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 292 - protein, 1273 aa, synthetic construct
  REGION 1..1273: note = SARS-CoV-2/England/200990660/2020__EPI_ISL_414523 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 293 - protein, 1273 aa, synthetic construct
  REGION 1..1273: note = SARS-CoV-2/Australia/NSW09/2020__EPI_ISL_413595 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 294 - protein, 1273 aa, synthetic construct
  REGION 1..1273: note = SARS-CoV-2/Australia/NSW10/2020__EPI_ISL_413596 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 295 - protein, 1273 aa, synthetic construct
  REGION 1..1273: note SARS-CoV-2/Switzerland/1000477797/2020__EPI_ISL_413023 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 296 - protein, 1273 aa, synthetic construct
  REGION 1..1273: note = SARS-CoV-2/Belgium/BA-02291/2020__EPI_ISL_415159 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 297 - protein, 1273 aa, synthetic construct
  REGION 1..1273: note = SARS-CoV-2/USA/WA8-UW5/2020__EPI_ISL_413486 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 298 - protein, 1273 aa, synthetic construct
  REGION 1..1273: note = SARS-CoV-2/England/20102000506/2020__EPI_ISL_415147 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 299 - protein, 1273 aa, synthetic construct
  REGION 1..1273: note = SARS-CoV-2/Belgium/VAG-03013/2020__EPI_ISL_415155 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 300 - protein, 1273 aa, synthetic construct
  REGION 1..1273: note = SARS-CoV-2/Belgium/BC-03016/2020__EPI_ISL_415157 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 301 - protein, 1273 aa, synthetic construct
  REGION 1..1273: note = SARS-CoV-2/Germany/BavPat3/2020__EPI_ISL_414521 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 302 - protein, 1273 aa, synthetic construct
  REGION 1..1273: note = SARS-CoV-2/France/HF1805/2020__EPI_ISL_414628 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 303 - protein, 1273 aa, synthetic construct
  REGION 1..1273: note SARS-CoV-2/Netherlands/ZuidHolland_9/2020__EPI_ISL_414445 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 304 - protein, 1273 aa, synthetic construct
  REGION 1..1273: note = SARS-CoV-2/Finland/FIN03032020A/2020__EPI_ISL_413602 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 305 - protein, 1273 aa, synthetic construct
  REGION 1..1273: note = SARS-CoV-2/France/GE1977/2020__EPI_ISL_414632 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 306 - protein, 1273 aa, synthetic construct
  REGION 1..1273: note = SARS-CoV-2/Finland/FIN-313/2020__EPI_ISL_414641 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 307 - protein, 1273 aa, synthetic construct
  REGION 1..1273: note SARS-CoV-2/Netherlands/ZuidHolland_2/2020__EPI_ISL_414556 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 308 - protein, 1273 aa, synthetic construct
  REGION 1..1273: note = SARS-CoV-2/USA/WA-UW31/2020__EPI_ISL_414618 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 309 - protein, 1273 aa, synthetic construct
  REGION 1..1273: note = SARS-CoV-2/South Korea/SNU01/2020__EPI_ISL_411929 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 310 - protein, 1273 aa, synthetic construct
  REGION 1..1273: note = SARS-CoV-2/China/WF0004/2020__EPI_ISL_413694 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 311 - protein, 1273 aa, synthetic construct
  REGION 1..1273: note = SARS-CoV-2/China/WF0028/2020__EPI_ISL_413791 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 312 - protein, 1273 aa, synthetic construct
  REGION 1..1273: note = SARS-CoV-2/2019-nCoV/USA-CruiseA-18/2020__MT159716.1 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 313 - protein, 1273 aa, synthetic construct
  REGION 1..1273: note SARS-CoV-2/SARS-CoV-2/Yunnan-01/human/2020/CHN__MT049951.1 spike protein (1-1273)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 314 - protein, 1273 aa, synthetic construct
  REGION 1..1273: note = SARS-CoV-2/USA/WA-UW292/2020__EPI_ISL_418077 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 315 - protein, 1273 aa, synthetic construct
  REGION 1..1273: note = SARS-CoV-2/Iceland/192/2020__EPI_ISL_417819 spike protein (1-1273)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 316 - protein, 1273 aa, synthetic construct
  REGION 1..1273: note = SARS-CoV-2/Belgium/ULG-6939/2020__EPI_ISL_417020 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 317 - protein, 1273 aa, synthetic construct
  REGION 1..1273: note = SARS-CoV-2/France/HF2496/2020__EPI_ISL_418231 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 318 - protein, 1273 aa, synthetic construct
  REGION 1..1273: note = SARS-CoV-2/USA/WA-UW291/2020__EPI_ISL_418076 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 319 - protein, 1273 aa, synthetic construct
  REGION 1..1273: note = SARS-CoV-2/Portugal/PT0034/2020__EPI_ISL_418019 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 320 - protein, 1273 aa, synthetic construct
  REGION 1..1273: note = SARS-CoV-2/Iceland/202/2020__EPI_ISL_417750 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 321 - protein, 1273 aa, synthetic construct
  REGION 1..1273: note = SARS-CoV-2/USA/WA-UW261/2020__EPI_ISL_418046 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 322 - protein, 1273 aa, synthetic construct
  REGION 1..1273: note = SARS-CoV-2/Portugal/PT0035/2020__EPI_ISL_418020 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 323 - protein, 1273 aa, synthetic construct
  REGION 1..1273: note = SARS-CoV-2/USA/NY-NYUMC7/2020__EPI_ISL_418192 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 324 - protein, 1273 aa, synthetic construct
  REGION 1..1273: note = SARS-CoV-2/Iceland/189/2020__EPI_ISL_417709 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 325 - protein, 1273 aa, synthetic construct
  REGION 1..1273: note = SARS-CoV-2/Australia/NSW56/2020__EPI_ISL_417408 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 326 - protein, 1273 aa, synthetic construct
  REGION 1..1273: note = SARS-CoV-2/Iceland/280/2020__EPI_ISL_417608 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 327 - protein, 1273 aa, synthetic construct
  REGION 1..1273: note = SARS-CoV-2/Iceland/247/2020__EPI_ISL_417575 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 328 - protein, 1273 aa, synthetic construct
  REGION 1..1273: note = SARS-CoV-2/Iceland/238/2020__EPI_ISL_417566 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 329 - protein, 1273 aa, synthetic construct
  REGION 1..1273: note = SARS-CoV-2/Greece/16/2020__EPI_ISL_418265 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 330 - protein, 1273 aa, synthetic construct
  REGION 1..1273: note = SARS-CoV-2/Iceland/319/2020__EPI_ISL_417648 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 331 - protein, 1273 aa, synthetic construct
  REGION 1..1273: note = SARS-CoV-2/Congo/94/2020__EPI_ISL_417947 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 332 - protein, 1273 aa, synthetic construct
  REGION 1..1273: note = SARS-CoV-2/Congo/158/2020__EPI_ISL_417950 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 333 - protein, 1273 aa, synthetic construct
  REGION 1..1273: note = SARS-CoV-2/USA/UT-00034/2020__EPI_ISL_417977 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 334 - protein, 1273 aa, synthetic construct
  REGION 1..1273: note = SARS-CoV-2/USA/UT-00033/2020__EPI_ISL_417976 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 335 - protein, 1273 aa, synthetic construct
  REGION 1..1273: note = SARS-CoV-2/USA/WI-13/2020__EPI_ISL_417516 spike protein (1-1273)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 336 - protein, 1272 aa, synthetic construct
  REGION 1..1272: note = SARS-CoV-2/India/1-27/2020__EPI_ISL_413522 spike protein (1-1272)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 337 - protein, 1267 aa, synthetic construct
  REGION 1..1267: note = SARS-CoV-2/pangolin/Guangxi/P4L/2017__EPI_ISL_410538 spike protein (1-1267)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 338 - protein, 1267 aa, synthetic construct
  REGION 1..1267: note = SARS-CoV-2/pangolin/Guangxi/P5L/2017__EPI_ISL_410540 spike protein (1-1267)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 339 - protein, 1267 aa, synthetic construct
  REGION 1..1267: note = SARS-CoV-2/pangolin/Guangxi/P5E/2017__EPI_ISL_410541 spike protein (1-1267)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 340 - protein, 1265 aa, synthetic construct
  REGION 1..1265: note = SARS-CoV-2/pangolin/Guangxi/P1E/2017__EPI_ISL_410539 spike protein (1-1265)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 341 - protein, 1273 aa, synthetic construct; identical to SEQ ID NO: 10
  REGION 1..1273: note = SARS-CoV-2/Wuhan/WIV05/2019__EPI_ISL_402128 spike protein (1-1273)(K986P_V987P)

SEQ ID NO: 342 - protein, 1269 aa, synthetic construct; identical to SEQ ID NO: 11
  REGION 1..1269: note = SARS-CoV-2/bat/Yunnan/RaTG13/2013__EPI_ISL_402131 spike protein (1-1269)(K982P_V983P)

SEQ ID NO: 343 - protein, 1273 aa, synthetic construct; identical to SEQ ID NO: 12
  REGION 1..1273: note = SARS-CoV-2/Wuhan/HBCDC-HB-01/2019__EPI_ISL_402132 spike protein (1-1273)(K986P_V987P)

SEQ ID NO: 344 - protein, 1273 aa, synthetic construct; identical to SEQ ID NO: 13
  REGION 1..1273: note = SARS-CoV-2/Guangdong/20SF028/2020__EPI_ISL_403936 spike protein (1-1273)(K986P_V987P)

SEQ ID NO: 345 - protein, 1273 aa, synthetic construct; identical to SEQ ID NO: 14
  REGION 1..1273: note = SARS-CoV-2/Shenzhen/SZTH-001/2020__EPI_ISL_406592 spike protein (1-1273)(K986P_V987P)

SEQ ID NO: 346 - protein, 1273 aa, synthetic construct; identical to SEQ ID NO: 15
  REGION 1..1273: note = SARS-CoV-2/Shenzhen/SZTH-004/2020__EPI_ISL_406595 spike protein (1-1273)(K986P_V987P)

SEQ ID NO: 347 - protein, 1273 aa, synthetic construct; identical to SEQ ID NO: 16
  REGION 1..1273: note = SARS-CoV-2/France/IDF0372/2020__EPI_ISL_406596 spike protein (1-1273)(K986P_V987P)

SEQ ID NO: 348 - protein, 1273 aa, synthetic construct; identical to SEQ ID NO: 17
  REGION 1..1273: note = SARS-CoV-2/Australia/VIC01/2020__EPI_ISL_406844 spike protein (1-1273)(K986P_V987P)

SEQ ID NO: 349 - protein, 1273 aa, synthetic construct; identical to SEQ ID NO: 18
  REGION 1..1273: note = SARS-CoV-2/Germany/BavPat1/2020__EPI_ISL_406862 spike protein (1-1273)(K986P_V987P)

SEQ ID NO: 350 - protein, 1273 aa, synthetic construct
  REGION 1..1273: note = SARS-CoV-2/Wuhan/HBCDC-HB-02/2020__EPI_ISL_412978 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 351 - protein, 1273 aa, synthetic construct
  REGION 1..1273: note = SARS-CoV-2/Australia/QLD02/2020__EPI_ISL_407896 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 352 - protein, 1273 aa, synthetic construct
  REGION 1..1273: note = SARS-CoV-2/India/1-31/2020__EPI_ISL_413523 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSVIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 353 - protein, 1273 aa, synthetic construct
  REGION 1..1273: note SARS-CoV-2/Guangdong/GD2020087-P0008/2020__EPI_ISL_413863 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 354 - protein, 1273 aa, synthetic construct
  REGION 1..1273: note = SARS-CoV-2/Sweden/01/2020__EPI_ISL_411951 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 355 - protein, 1273 aa, synthetic construct
  REGION 1..1273: note = SARS-CoV-2/Tianmen/HBCDC-HB-07/2020__EPI_ISL_412983 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 356 - protein, 1273 aa, synthetic construct
  REGION 1..1273: note = SARS-CoV-2/Hong Kong/case42_VM20002493/2020__EPI_ISL_414527 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 357 - protein, 1273 aa, synthetic construct
  REGION 1..1273: note = SARS-CoV-2/USA/CruiseA-23/2020__EPI_ISL_414482 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 358 - protein, 1273 aa, synthetic construct
  REGION 1..1273: note = SARS-CoV-2/Hong Kong/case85_VM20002868/2020__EPI_ISL_414519 spike protein (1-1273)(K986P_V987P)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 359 - protein, 1273 aa, synthetic construct
  REGION 1..1273: note = SARS-CoV-2/England/200990660/2020__EPI_ISL_414523 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 360 - protein, 1273 aa, synthetic construct
  REGION 1..1273: note = SARS-CoV-2/Australia/NSW09/2020__EPI_ISL_413595 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSFTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 361 - protein, 1273 aa, synthetic construct
  REGION 1..1273: note = SARS-CoV-2/Australia/NSW10/2020__EPI_ISL_413596 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 362 - protein, 1273 aa, synthetic construct
  REGION 1..1273: note SARS-CoV-2/Switzerland/1000477797/2020__EPI_ISL_413023 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 363 - protein, 1273 aa, synthetic construct
  REGION 1..1273: note = SARS-CoV-2/Belgium/BA-02291/2020__EPI_ISL_415159 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSAAPALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 364 - protein, 1273 aa, synthetic construct
  REGION 1..1273: note = SARS-CoV-2/USA/WA8-UW5/2020__EPI_ISL_413486 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 365 - protein, 1273 aa, synthetic construct
  REGION 1..1273: note = SARS-CoV-2/England/20102000506/2020__EPI_ISL_415147 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 366 - protein, 1273 aa, synthetic construct
  REGION 1..1273: note = SARS-CoV-2/Belgium/VAG-03013/2020__EPI_ISL_415155 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTATALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 367 - protein, 1273 aa, synthetic construct
  REGION 1..1273: note = SARS-CoV-2/Belgium/BC-03016/2020__EPI_ISL_415157 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTAPALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 368 - protein, 1273 aa, synthetic construct
  REGION 1..1273: note = SARS-CoV-2/Germany/BavPat3/2020__EPI_ISL_414521 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 369 - protein, 1273 aa, synthetic construct
  REGION 1..1273: note = SARS-CoV-2/France/HF1805/2020__EPI_ISL_414628 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 370 - protein, 1273 aa, synthetic construct
  REGION 1..1273: note SARS-CoV-2/Netherlands/ZuidHolland_9/2020__EPI_ISL_414445 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 371 - protein, 1273 aa, synthetic construct
  REGION 1..1273: note = SARS-CoV-2/Finland/FIN03032020A/2020__EPI_ISL_413602 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 372 - protein, 1273 aa, synthetic construct
  REGION 1..1273: note = SARS-CoV-2/France/GE1977/2020__EPI_ISL_414632 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLFSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 373 - protein, 1273 aa, synthetic construct
  REGION 1..1273: note = SARS-CoV-2/Finland/FIN-313/2020__EPI_ISL_414641 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 374 - protein, 1273 aa, synthetic construct
  REGION 1..1273: note SARS-CoV-2/Netherlands/ZuidHolland_2/2020__EPI_ISL_414556 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 375 - protein, 1273 aa, synthetic construct
  REGION 1..1273: note = SARS-CoV-2/USA/WA-UW31/2020__EPI_ISL_414618 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 376 - protein, 1273 aa, synthetic construct
  REGION 1..1273: note = SARS-CoV-2/South Korea/SNU01/2020__EPI_ISL_411929 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 377 - protein, 1273 aa, synthetic construct
  REGION 1..1273: note = SARS-CoV-2/China/WF0004/2020__EPI_ISL_413694 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 378 - protein, 1273 aa, synthetic construct
  REGION 1..1273: note = SARS-CoV-2/China/WF0028/2020__EPI_ISL_413791 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 379 - protein, 1273 aa, synthetic construct
  REGION 1..1273: note = SARS-CoV-2/2019-nCoV/USA-CruiseA-18/2020__MT159716.1 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 380 - protein, 1273 aa, synthetic construct
  REGION 1..1273: note SARS-CoV-2/SARS-CoV-2/Yunnan-01/human/2020/CHN__MT049951.1 spike protein (1-1273)(K986P_V987P)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 381 - protein, 1273 aa, synthetic construct
  REGION 1..1273: note = SARS-CoV-2/USA/WA-UW292/2020__EPI_ISL_418077 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 382 - protein, 1273 aa, synthetic construct
  REGION 1..1273: note = SARS-CoV-2/Iceland/192/2020__EPI_ISL_417819 spike protein (1-1273)(K986P_V987P)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 383 - protein, 1273 aa, synthetic construct
  REGION 1..1273: note = SARS-CoV-2/Belgium/ULG-6939/2020__EPI_ISL_417020 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 384 - protein, 1273 aa, synthetic construct
  REGION 1..1273: note = SARS-CoV-2/France/HF2496/2020__EPI_ISL_418231 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 385 - protein, 1273 aa, synthetic construct
  REGION 1..1273: note = SARS-CoV-2/USA/WA-UW291/2020__EPI_ISL_418076 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQYSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 386 - protein, 1273 aa, synthetic construct
  REGION 1..1273: note = SARS-CoV-2/Portugal/PT0034/2020__EPI_ISL_418019 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 387 - protein, 1273 aa, synthetic construct
  REGION 1..1273: note = SARS-CoV-2/Iceland/202/2020__EPI_ISL_417750 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 388 - protein, 1273 aa, synthetic construct
  REGION 1..1273: note = SARS-CoV-2/USA/WA-UW261/2020__EPI_ISL_418046 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 389 - protein, 1273 aa, synthetic construct
  REGION 1..1273: note = SARS-CoV-2/Portugal/PT0035/2020__EPI_ISL_418020 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 390 - protein, 1273 aa, synthetic construct
  REGION 1..1273: note = SARS-CoV-2/USA/NY-NYUMC7/2020__EPI_ISL_418192 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 391 - protein, 1273 aa, synthetic construct
  REGION 1..1273: note = SARS-CoV-2/Iceland/189/2020__EPI_ISL_417709 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 392 - protein, 1273 aa, synthetic construct
  REGION 1..1273: note = SARS-CoV-2/Australia/NSW56/2020__EPI_ISL_417408 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 393 - protein, 1273 aa, synthetic construct
  REGION 1..1273: note = SARS-CoV-2/Iceland/280/2020__EPI_ISL_417608 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 394 - protein, 1273 aa, synthetic construct
  REGION 1..1273: note = SARS-CoV-2/Iceland/247/2020__EPI_ISL_417575 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 395 - protein, 1273 aa, synthetic construct
  REGION 1..1273: note = SARS-CoV-2/Iceland/238/2020__EPI_ISL_417566 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 396 - protein, 1273 aa, synthetic construct
  REGION 1..1273: note = SARS-CoV-2/Greece/16/2020__EPI_ISL_418265 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 397 - protein, 1273 aa, synthetic construct
  REGION 1..1273: note = SARS-CoV-2/Iceland/319/2020__EPI_ISL_417648 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 398 - protein, 1273 aa, synthetic construct
  REGION 1..1273: note = SARS-CoV-2/Congo/94/2020__EPI_ISL_417947 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 399 - protein, 1273 aa, synthetic construct
  REGION 1..1273: note = SARS-CoV-2/Congo/158/2020__EPI_ISL_417950 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 400 - protein, 1273 aa, synthetic construct
  REGION 1..1273: note = SARS-CoV-2/USA/UT-00034/2020__EPI_ISL_417977 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 401 - protein, 1273 aa, synthetic construct
  REGION 1..1273: note = SARS-CoV-2/USA/UT-00033/2020__EPI_ISL_417976 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 402 - protein, 1273 aa, synthetic construct
  REGION 1..1273: note = SARS-CoV-2/USA/WI-13/2020__EPI_ISL_417516 spike protein (1-1273)(K986P_V987P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 403 - protein, 1272 aa, synthetic construct
  REGION 1..1272: note = SARS-CoV-2/India/1-27/2020__EPI_ISL_413522 spike protein (1-1272)(K985P_V986P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 404 - protein, 1267 aa, synthetic construct
  REGION 1..1267: note = SARS-CoV-2/pangolin/Guangxi/P4L/2017__EPI_ISL_410538 spike protein (1-1267)(K980P_V981P)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 405 - protein, 1267 aa, synthetic construct
  REGION 1..1267: note = SARS-CoV-2/pangolin/Guangxi/P5L/2017__EPI_ISL_410540 spike protein (1-1267)(K980P_V981P)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 406 - protein, 1267 aa, synthetic construct
  REGION 1..1267: note = SARS-CoV-2/pangolin/Guangxi/P5E/2017__EPI_ISL_410541 spike protein (1-1267)(K980P_V981P)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 407 - protein, 1265 aa, synthetic construct
  REGION 1..1265: note = SARS-CoV-2/pangolin/Guangxi/P1E/2017__EPI_ISL_410539 spike protein (1-1265)(K978P_V979P)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 408 - protein, 1273 aa, synthetic construct
  REGION 1..1273: note = SARS-CoV-2/Wuhan/WIV05/2019__EPI_ISL_402128 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 409 - protein, 1269 aa, synthetic construct
  REGION 1..1269: note = SARS-CoV-2/bat/Yunnan/RaTG13/2013__EPI_ISL_402131 spike protein (1-1269)(K982P_V983P_T883W_A1016W)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 410 - protein, 1273 aa, synthetic construct
  REGION 1..1273: note = SARS-CoV-2/Wuhan/HBCDC-HB-01/2019__EPI_ISL_402132 spike protein (1-1273)(K986P_V987P_T887W_A1020W)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 411 - protein, 1273 aa, synthetic construct
  REGION 1..1273: note = SARS-CoV-2/Guangdong/20SF028/2020__EPI_ISL_403936 spike protein (1-1273)(K986P_V987P_T887W_A1020W)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 412 - protein, 1273 aa, synthetic construct
  REGION 1..1273: note = SARS-CoV-2/Shenzhen/SZTH-001/2020__EPI_ISL_406592 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 413 - protein, 1273 aa, synthetic construct
  REGION 1..1273: note = SARS-CoV-2/Shenzhen/SZTH-004/2020__EPI_ISL_406595 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 414 - protein, 1273 aa, synthetic construct
  REGION 1..1273: note = SARS-CoV-2/France/IDF0372/2020__EPI_ISL_406596 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 415 - protein, 1273 aa, synthetic construct
  REGION 1..1273: note = SARS-CoV-2/Australia/VIC01/2020__EPI_ISL_406844 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 416 - protein, 1273 aa, synthetic construct
  REGION 1..1273: note = SARS-CoV-2/Germany/BavPat1/2020__EPI_ISL_406862 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 417 - protein, 1273 aa, synthetic construct
  REGION 1..1273: note = SARS-CoV-2/Wuhan/HBCDC-HB-02/2020__EPI_ISL_412978 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 418 - protein, 1273 aa, synthetic construct
  REGION 1..1273: note = SARS-CoV-2/Australia/QLD02/2020__EPI_ISL_407896 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 419 - protein, 1273 aa, synthetic construct
  REGION 1..1273: note = SARS-CoV-2/India/1-31/2020__EPI_ISL_413523 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSVIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 420 - protein, 1273 aa, synthetic construct
  REGION 1..1273: note SARS-CoV-2/Guangdong/GD2020087-P0008/2020__EPI_ISL_413863 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 421 - protein, 1273 aa, synthetic construct
  REGION 1..1273: note = SARS-CoV-2/Sweden/01/2020__EPI_ISL_411951 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 422 - protein, 1273 aa, synthetic construct
  REGION 1..1273: note = SARS-CoV-2/Tianmen/HBCDC-HB-07/2020__EPI_ISL_412983 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 423 - protein, 1273 aa, synthetic construct
  REGION 1..1273: note = SARS-CoV-2/Hong Kong/case42_VM20002493/2020__EPI_ISL_414527 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 424 - protein, 1273 aa, synthetic construct
  REGION 1..1273: note = SARS-CoV-2/USA/CruiseA-23/2020__EPI_ISL_414482 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 425 - protein, 1273 aa, synthetic construct
  REGION 1..1273: note = SARS-CoV-2/Hong Kong/case85_VM20002868/2020__EPI_ISL_414519 spike protein (1-1273)(K986P_V987P_T887W_A1020W)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 426 - protein, 1273 aa, synthetic construct
  REGION 1..1273: note = SARS-CoV-2/England/200990660/2020__EPI_ISL_414523 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 427 - protein, 1273 aa, synthetic construct
  REGION 1..1273: note = SARS-CoV-2/Australia/NSW09/2020__EPI_ISL_413595 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSFTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 428 - protein, 1273 aa, synthetic construct
  REGION 1..1273: note = SARS-CoV-2/Australia/NSW10/2020__EPI_ISL_413596 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 429 - protein, 1273 aa, synthetic construct
  REGION 1..1273: note SARS-CoV-2/Switzerland/1000477797/2020__EPI_ISL_413023 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 430 - protein, 1273 aa, synthetic construct
  REGION 1..1273: note = SARS-CoV-2/Belgium/BA-02291/2020__EPI_ISL_415159 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSAAPALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 431 - protein, 1273 aa, synthetic construct
  REGION 1..1273: note = SARS-CoV-2/USA/WA8-UW5/2020__EPI_ISL_413486 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 432 - protein, 1273 aa, synthetic construct
  REGION 1..1273: note = SARS-CoV-2/England/20102000506/2020__EPI_ISL_415147 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 433 - protein, 1273 aa, synthetic construct
  REGION 1..1273: note = SARS-CoV-2/Belgium/VAG-03013/2020__EPI_ISL_415155 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTATALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 434 - protein, 1273 aa, synthetic construct
  REGION 1..1273: note = SARS-CoV-2/Belgium/BC-03016/2020__EPI_ISL_415157 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTAPALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 435 - protein, 1273 aa, synthetic construct
  REGION 1..1273: note = SARS-CoV-2/Germany/BavPat3/2020__EPI_ISL_414521 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 436 - protein, 1273 aa, synthetic construct
  REGION 1..1273: note = SARS-CoV-2/France/HF1805/2020__EPI_ISL_414628 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 437 - protein, 1273 aa, synthetic construct
  REGION 1..1273: note SARS-CoV-2/Netherlands/ZuidHolland_9/2020__EPI_ISL_414445 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 438 - protein, 1273 aa, synthetic construct
  REGION 1..1273: note = SARS-CoV-2/Finland/FIN03032020A/2020__EPI_ISL_413602 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 439 - protein, 1273 aa, synthetic construct
  REGION 1..1273: note = SARS-CoV-2/France/GE1977/2020__EPI_ISL_414632 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLFSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 440 - protein, 1273 aa, synthetic construct
  REGION 1..1273: note = SARS-CoV-2/Finland/FIN-313/2020__EPI_ISL_414641 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 441 - protein, 1273 aa, synthetic construct
  REGION 1..1273: note SARS-CoV-2/Netherlands/ZuidHolland_2/2020__EPI_ISL_414556 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 442 - protein, 1273 aa, synthetic construct
  REGION 1..1273: note = SARS-CoV-2/USA/WA-UW31/2020__EPI_ISL_414618 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 443 - protein, 1273 aa, synthetic construct
  REGION 1..1273: note = SARS-CoV-2/South Korea/SNU01/2020__EPI_ISL_411929 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 444 - protein, 1273 aa, synthetic construct
  REGION 1..1273: note = SARS-CoV-2/China/WF0004/2020__EPI_ISL_413694 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 445 - protein, 1273 aa, synthetic construct
  REGION 1..1273: note = SARS-CoV-2/China/WF0028/2020__EPI_ISL_413791 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 446 - protein, 1273 aa, synthetic construct
  REGION 1..1273: note = SARS-CoV-2/2019-nCoV/USA-CruiseA-18/2020__MT159716.1 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 447 - protein, 1273 aa, synthetic construct
  REGION 1..1273: note SARS-CoV-2/SARS-CoV-2/Yunnan-01/human/2020/CHN__MT049951.1 spike protein (1-1273)(K986P_V987P_T887W_A1020W)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 448 - protein, 1273 aa, synthetic construct
  REGION 1..1273: note = SARS-CoV-2/USA/WA-UW292/2020__EPI_ISL_418077 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 449 - protein, 1273 aa, synthetic construct
  REGION 1..1273: note = SARS-CoV-2/Iceland/192/2020__EPI_ISL_417819 spike protein (1-1273)(K986P_V987P_T887W_A1020W)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 450 - protein, 1273 aa, synthetic construct
  REGION 1..1273: note = SARS-CoV-2/Belgium/ULG-6939/2020__EPI_ISL_417020 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 451 - protein, 1273 aa, synthetic construct
  REGION 1..1273: note = SARS-CoV-2/France/HF2496/2020__EPI_ISL_418231 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 452 - protein, 1273 aa, synthetic construct
  REGION 1..1273: note = SARS-CoV-2/USA/WA-UW291/2020__EPI_ISL_418076 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQYSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 453 - protein, 1273 aa, synthetic construct
  REGION 1..1273: note = SARS-CoV-2/Portugal/PT0034/2020__EPI_ISL_418019 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 454 - protein, 1273 aa, synthetic construct
  REGION 1..1273: note = SARS-CoV-2/Iceland/202/2020__EPI_ISL_417750 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 455 - protein, 1273 aa, synthetic construct
  REGION 1..1273: note = SARS-CoV-2/USA/WA-UW261/2020__EPI_ISL_418046 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 456 - protein, 1273 aa, synthetic construct
  REGION 1..1273: note = SARS-CoV-2/Portugal/PT0035/2020__EPI_ISL_418020 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 457 - protein, 1273 aa, synthetic construct
  REGION 1..1273: note = SARS-CoV-2/USA/NY-NYUMC7/2020__EPI_ISL_418192 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 458 - protein, 1273 aa, synthetic construct
  REGION 1..1273: note = SARS-CoV-2/Iceland/189/2020__EPI_ISL_417709 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 459 - protein, 1273 aa, synthetic construct
  REGION 1..1273: note = SARS-CoV-2/Australia/NSW56/2020__EPI_ISL_417408 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 460 - protein, 1273 aa, synthetic construct
  REGION 1..1273: note = SARS-CoV-2/Iceland/280/2020__EPI_ISL_417608 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 461 - protein, 1273 aa, synthetic construct
  REGION 1..1273: note = SARS-CoV-2/Iceland/247/2020__EPI_ISL_417575 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 462 - protein, 1273 aa, synthetic construct
  REGION 1..1273: note = SARS-CoV-2/Iceland/238/2020__EPI_ISL_417566 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 463 - protein, 1273 aa, synthetic construct
  REGION 1..1273: note = SARS-CoV-2/Greece/16/2020__EPI_ISL_418265 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 464 - protein, 1273 aa, synthetic construct
  REGION 1..1273: note = SARS-CoV-2/Iceland/319/2020__EPI_ISL_417648 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 465 - protein, 1273 aa, synthetic construct
  REGION 1..1273: note = SARS-CoV-2/Congo/94/2020__EPI_ISL_417947 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 466 - protein, 1273 aa, synthetic construct
  REGION 1..1273: note = SARS-CoV-2/Congo/158/2020__EPI_ISL_417950 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 467 - protein, 1273 aa, synthetic construct
  REGION 1..1273: note = SARS-CoV-2/USA/UT-00034/2020__EPI_ISL_417977 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 468 - protein, 1273 aa, synthetic construct
  REGION 1..1273: note = SARS-CoV-2/USA/UT-00033/2020__EPI_ISL_417976 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 469 - protein, 1273 aa, synthetic construct
  REGION 1..1273: note = SARS-CoV-2/USA/WI-13/2020__EPI_ISL_417516 spike protein (1-1273)(K986P_V987P_T887W_A1020W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 470 - protein, 1272 aa, synthetic construct
  REGION 1..1272: note = SARS-CoV-2/India/1-27/2020__EPI_ISL_413522 spike protein (1-1272)(K985P_V986P_T886W_A1019W)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 471 - protein, 1267 aa, synthetic construct
  REGION 1..1267: note = SARS-CoV-2/pangolin/Guangxi/P4L/2017__EPI_ISL_410538 spike protein (1-1267)(K980P_V981P_T881W_A1014W)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 472 - protein, 1267 aa, synthetic construct
  REGION 1..1267: note = SARS-CoV-2/pangolin/Guangxi/P5L/2017__EPI_ISL_410540 spike protein (1-1267)(K980P_V981P_T881W_A1014W)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 473 - protein, 1267 aa, synthetic construct
  REGION 1..1267: note = SARS-CoV-2/pangolin/Guangxi/P5E/2017__EPI_ISL_410541 spike protein (1-1267)(K980P_V981P_T881W_A1014W)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 474 - protein, 1265 aa, synthetic construct
  REGION 1..1265: note = SARS-CoV-2/pangolin/Guangxi/P1E/2017__EPI_ISL_410539 spike protein (1-1265)(K978P_V979P_T879W_A1012W)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWWFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRWSANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 475 - protein, 1273 aa, synthetic construct
  REGION 1..1273: note = SARS-CoV-2/Wuhan/WIV05/2019__EPI_ISL_402128 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 476 - protein, 1269 aa, synthetic construct
  REGION 1..1269: note = SARS-CoV-2/bat/Yunnan/RaTG13/2013__EPI_ISL_402131 spike protein (1-1269)(K982P_V983P_P1065F)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 477 - protein, 1273 aa, synthetic construct
  REGION 1..1273: note = SARS-CoV-2/Wuhan/HBCDC-HB-01/2019__EPI_ISL_402132 spike protein (1-1273)(K986P_V987P_P1069F)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 478 - protein, 1273 aa, synthetic construct
  REGION 1..1273: note = SARS-CoV-2/Guangdong/20SF028/2020__EPI_ISL_403936 spike protein (1-1273)(K986P_V987P_P1069F)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 479 - protein, 1273 aa, synthetic construct
  REGION 1..1273: note = SARS-CoV-2/Shenzhen/SZTH-001/2020__EPI_ISL_406592 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 480 - protein, 1273 aa, synthetic construct
  REGION 1..1273: note = SARS-CoV-2/Shenzhen/SZTH-004/2020__EPI_ISL_406595 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 481 - protein, 1273 aa, synthetic construct
  REGION 1..1273: note = SARS-CoV-2/France/IDF0372/2020__EPI_ISL_406596 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 482 - protein, 1273 aa, synthetic construct
  REGION 1..1273: note = SARS-CoV-2/Australia/VIC01/2020__EPI_ISL_406844 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 483 - protein, 1273 aa, synthetic construct
  REGION 1..1273: note = SARS-CoV-2/Germany/BavPat1/2020__EPI_ISL_406862 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 484 - protein, 1273 aa, synthetic construct
  REGION 1..1273: note = SARS-CoV-2/Wuhan/HBCDC-HB-02/2020__EPI_ISL_412978 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 485 - protein, 1273 aa, synthetic construct
  REGION 1..1273: note = SARS-CoV-2/Australia/QLD02/2020__EPI_ISL_407896 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 486 - protein, 1273 aa, synthetic construct
  REGION 1..1273: note = SARS-CoV-2/India/1-31/2020__EPI_ISL_413523 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSVIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 487 - protein, 1273 aa, synthetic construct
  REGION 1..1273: note SARS-CoV-2/Guangdong/GD2020087-P0008/2020__EPI_ISL_413863 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 488 - protein, 1273 aa, synthetic construct
  REGION 1..1273: note = SARS-CoV-2/Sweden/01/2020__EPI_ISL_411951 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 489 - protein, 1273 aa, synthetic construct
  REGION 1..1273: note = SARS-CoV-2/Tianmen/HBCDC-HB-07/2020__EPI_ISL_412983 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 490 - protein, 1273 aa, synthetic construct
  REGION 1..1273: note = SARS-CoV-2/Hong Kong/case42_VM20002493/2020__EPI_ISL_414527 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 491 - protein, 1273 aa, synthetic construct
  REGION 1..1273: note = SARS-CoV-2/USA/CruiseA-23/2020__EPI_ISL_414482 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 492 - protein, 1273 aa, synthetic construct
  REGION 1..1273: note = SARS-CoV-2/Hong Kong/case85_VM20002868/2020__EPI_ISL_414519 spike protein (1-1273)(K986P_V987P_P1069F)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 493 - protein, 1273 aa, synthetic construct
  REGION 1..1273: note = SARS-CoV-2/England/200990660/2020__EPI_ISL_414523 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 494 - protein, 1273 aa, synthetic construct
  REGION 1..1273: note = SARS-CoV-2/Australia/NSW09/2020__EPI_ISL_413595 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSFTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 495 - protein, 1273 aa, synthetic construct
  REGION 1..1273: note = SARS-CoV-2/Australia/NSW10/2020__EPI_ISL_413596 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 496 - protein, 1273 aa, synthetic construct
  REGION 1..1273: note SARS-CoV-2/Switzerland/1000477797/2020__EPI_ISL_413023 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 497 - protein, 1273 aa, synthetic construct
  REGION 1..1273: note = SARS-CoV-2/Belgium/BA-02291/2020__EPI_ISL_415159 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSAAPALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 498 - protein, 1273 aa, synthetic construct
  REGION 1..1273: note = SARS-CoV-2/USA/WA8-UW5/2020__EPI_ISL_413486 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 499 - protein, 1273 aa, synthetic construct
  REGION 1..1273: note = SARS-CoV-2/England/20102000506/2020__EPI_ISL_415147 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 500 - protein, 1273 aa, synthetic construct
  REGION 1..1273: note = SARS-CoV-2/Belgium/VAG-03013/2020__EPI_ISL_415155 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTATALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 501 - protein, 1273 aa, synthetic construct
  REGION 1..1273: note = SARS-CoV-2/Belgium/BC-03016/2020__EPI_ISL_415157 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTAPALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 502 - protein, 1273 aa, synthetic construct
  REGION 1..1273: note = SARS-CoV-2/Germany/BavPat3/2020__EPI_ISL_414521 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 503 - protein, 1273 aa, synthetic construct
  REGION 1..1273: note = SARS-CoV-2/France/HF1805/2020__EPI_ISL_414628 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 504 - protein, 1273 aa, synthetic construct
  REGION 1..1273: note SARS-CoV-2/Netherlands/ZuidHolland_9/2020__EPI_ISL_414445 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 505 - protein, 1273 aa, synthetic construct
  REGION 1..1273: note = SARS-CoV-2/Finland/FIN03032020A/2020__EPI_ISL_413602 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 506 - protein, 1273 aa, synthetic construct
  REGION 1..1273: note = SARS-CoV-2/France/GE1977/2020__EPI_ISL_414632 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLFSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 507 - protein, 1273 aa, synthetic construct
  REGION 1..1273: note = SARS-CoV-2/Finland/FIN-313/2020__EPI_ISL_414641 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 508 - protein, 1273 aa, synthetic construct
  REGION 1..1273: note SARS-CoV-2/Netherlands/ZuidHolland_2/2020__EPI_ISL_414556 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 509 - protein, 1273 aa, synthetic construct
  REGION 1..1273: note = SARS-CoV-2/USA/WA-UW31/2020__EPI_ISL_414618 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 510 - protein, 1273 aa, synthetic construct
  REGION 1..1273: note = SARS-CoV-2/South Korea/SNU01/2020__EPI_ISL_411929 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 511 - protein, 1273 aa, synthetic construct
  REGION 1..1273: note = SARS-CoV-2/China/WF0004/2020__EPI_ISL_413694 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRFDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 512 - protein, 1273 aa, synthetic construct
  REGION 1..1273: note = SARS-CoV-2/China/WF0028/2020__EPI_ISL_413791 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 513 - protein, 1273 aa, synthetic construct
  REGION 1..1273: note = SARS-CoV-2/2019-nCoV/USA-CruiseA-18/2020__MT159716.1 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 514 - protein, 1273 aa, synthetic construct
  REGION 1..1273: note SARS-CoV-2/SARS-CoV-2/Yunnan-01/human/2020/CHN__MT049951.1 spike protein (1-1273)(K986P_V987P_P1069F)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 515 - protein, 1273 aa, synthetic construct
  REGION 1..1273: note = SARS-CoV-2/USA/WA-UW292/2020__EPI_ISL_418077 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 516 - protein, 1273 aa, synthetic construct
  REGION 1..1273: note = SARS-CoV-2/Iceland/192/2020__EPI_ISL_417819 spike protein (1-1273)(K986P_V987P_P1069F)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 517 - protein, 1273 aa, synthetic construct
  REGION 1..1273: note = SARS-CoV-2/Belgium/ULG-6939/2020__EPI_ISL_417020 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 518 - protein, 1273 aa, synthetic construct
  REGION 1..1273: note = SARS-CoV-2/France/HF2496/2020__EPI_ISL_418231 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 519 - protein, 1273 aa, synthetic construct
  REGION 1..1273: note = SARS-CoV-2/USA/WA-UW291/2020__EPI_ISL_418076 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQYSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 520 - protein, 1273 aa, synthetic construct
  REGION 1..1273: note = SARS-CoV-2/Portugal/PT0034/2020__EPI_ISL_418019 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 521 - protein, 1273 aa, synthetic construct
  REGION 1..1273: note = SARS-CoV-2/Iceland/202/2020__EPI_ISL_417750 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 522 - protein, 1273 aa, synthetic construct
  REGION 1..1273: note = SARS-CoV-2/USA/WA-UW261/2020__EPI_ISL_418046 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 523 - protein, 1273 aa, synthetic construct
  REGION 1..1273: note = SARS-CoV-2/Portugal/PT0035/2020__EPI_ISL_418020 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 524 - protein, 1273 aa, synthetic construct
  REGION 1..1273: note = SARS-CoV-2/USA/NY-NYUMC7/2020__EPI_ISL_418192 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 525 - protein, 1273 aa, synthetic construct
  REGION 1..1273: note = SARS-CoV-2/Iceland/189/2020__EPI_ISL_417709 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 526 - protein, 1273 aa, synthetic construct
  REGION 1..1273: note = SARS-CoV-2/Australia/NSW56/2020__EPI_ISL_417408 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 527 - protein, 1273 aa, synthetic construct
  REGION 1..1273: note = SARS-CoV-2/Iceland/280/2020__EPI_ISL_417608 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 528 - protein, 1273 aa, synthetic construct
  REGION 1..1273: note = SARS-CoV-2/Iceland/247/2020__EPI_ISL_417575 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 529 - protein, 1273 aa, synthetic construct
  REGION 1..1273: note = SARS-CoV-2/Iceland/238/2020__EPI_ISL_417566 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 530 - protein, 1273 aa, synthetic construct
  REGION 1..1273: note = SARS-CoV-2/Greece/16/2020__EPI_ISL_418265 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 531 - protein, 1273 aa, synthetic construct
  REGION 1..1273: note = SARS-CoV-2/Iceland/319/2020__EPI_ISL_417648 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 532 - protein, 1273 aa, synthetic construct
  REGION 1..1273: note = SARS-CoV-2/Congo/94/2020__EPI_ISL_417947 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 533 - protein, 1273 aa, synthetic construct
  REGION 1..1273: note = SARS-CoV-2/Congo/158/2020__EPI_ISL_417950 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 534 - protein, 1273 aa, synthetic construct
  REGION 1..1273: note = SARS-CoV-2/USA/UT-00034/2020__EPI_ISL_417977 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 535 - protein, 1273 aa, synthetic construct
  REGION 1..1273: note = SARS-CoV-2/USA/UT-00033/2020__EPI_ISL_417976 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 536 - protein, 1273 aa, synthetic construct
  REGION 1..1273: note = SARS-CoV-2/USA/WI-13/2020__EPI_ISL_417516 spike protein (1-1273)(K986P_V987P_P1069F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 537 - protein, 1272 aa, synthetic construct
  REGION 1..1272: note = SARS-CoV-2/India/1-27/2020__EPI_ISL_413522 spike protein (1-1272)(K985P_V986P_P1068F)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 538 - protein, 1267 aa, synthetic construct
  REGION 1..1267: note = SARS-CoV-2/pangolin/Guangxi/P4L/2017__EPI_ISL_410538 spike protein (1-1267)(K980P_V981P_P1063F)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 539 - protein, 1267 aa, synthetic construct
  REGION 1..1267: note = SARS-CoV-2/pangolin/Guangxi/P5L/2017__EPI_ISL_410540 spike protein (1-1267)(K980P_V981P_P1063F)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 540 - protein, 1267 aa, synthetic construct
  REGION 1..1267: note = SARS-CoV-2/pangolin/Guangxi/P5E/2017__EPI_ISL_410541 spike protein (1-1267)(K980P_V981P_P1063F)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 541 - protein, 1265 aa, synthetic construct
  REGION 1..1265: note = SARS-CoV-2/pangolin/Guangxi/P1E/2017__EPI_ISL_410539 spike protein (1-1265)(K978P_V979P_P1061F)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVFAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 542 - protein, 1273 aa, synthetic construct
  REGION 1..1273: note = SARS-CoV-2/Wuhan/WIV05/2019__EPI_ISL_402128 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 543 - protein, 1269 aa, synthetic construct
  REGION 1..1269: note = SARS-CoV-2/bat/Yunnan/RaTG13/2013__EPI_ISL_402131 spike protein (1-1269)(K982P_V983P_ H1044Q_H1060N_ H1079N_H1097N)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 544 - protein, 1273 aa, synthetic construct
  REGION 1..1273: note = SARS-CoV-2/Wuhan/HBCDC-HB-01/2019__EPI_ISL_402132 spike protein (1-1273)(K986P_V987P_ H1048Q_H1064N_ H1083N_H1101N)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 545 - protein, 1273 aa, synthetic construct
  REGION 1..1273: note = SARS-CoV-2/Guangdong/20SF028/2020__EPI_ISL_403936 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 546 - protein, 1273 aa, synthetic construct
  REGION 1..1273: note = SARS-CoV-2/Shenzhen/SZTH-001/2020__EPI_ISL_406592 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 547 - protein, 1273 aa, synthetic construct
  REGION 1..1273: note = SARS-CoV-2/Shenzhen/SZTH-004/2020__EPI_ISL_406595 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 548 - protein, 1273 aa, synthetic construct
  REGION 1..1273: note = SARS-CoV-2/France/IDF0372/2020__EPI_ISL_406596 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 549 - protein, 1273 aa, synthetic construct
  REGION 1..1273: note = SARS-CoV-2/Australia/VIC01/2020__EPI_ISL_406844 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 550 - protein, 1273 aa, synthetic construct
  REGION 1..1273: note = SARS-CoV-2/Germany/BavPat1/2020__EPI_ISL_406862 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 551 - protein, 1273 aa, synthetic construct
  REGION 1..1273: note = SARS-CoV-2/Wuhan/HBCDC-HB-02/2020__EPI_ISL_412978 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 552 - protein, 1273 aa, synthetic construct
  REGION 1..1273: note = SARS-CoV-2/Australia/QLD02/2020__EPI_ISL_407896 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 553 - protein, 1273 aa, synthetic construct
  REGION 1..1273: note = SARS-CoV-2/India/1-31/2020__EPI_ISL_413523 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSVIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 554 - protein, 1273 aa, synthetic construct
  REGION 1..1273: note SARS-CoV-2/Guangdong/GD2020087-P0008/2020__EPI_ISL_413863 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 555 - protein, 1273 aa, synthetic construct
  REGION 1..1273: note = SARS-CoV-2/Sweden/01/2020__EPI_ISL_411951 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 556 - protein, 1273 aa, synthetic construct
  REGION 1..1273: note = SARS-CoV-2/Tianmen/HBCDC-HB-07/2020__EPI_ISL_412983 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 557 - protein, 1273 aa, synthetic construct
  REGION 1..1273: note = SARS-CoV-2/Hong Kong/case42_VM20002493/2020__EPI_ISL_414527 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 558 - protein, 1273 aa, synthetic construct
  REGION 1..1273: note = SARS-CoV-2/USA/CruiseA-23/2020__EPI_ISL_414482 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 559 - protein, 1273 aa, synthetic construct
  REGION 1..1273: note = SARS-CoV-2/Hong Kong/case85_VM20002868/2020__EPI_ISL_414519 spike protein (1-1273)(K986P_V987P_ H1048Q_H1064N_ H1083N_H1101N)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 560 - protein, 1273 aa, synthetic construct
  REGION 1..1273: note = SARS-CoV-2/England/200990660/2020__EPI_ISL_414523 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 561 - protein, 1273 aa, synthetic construct
  REGION 1..1273: note = SARS-CoV-2/Australia/NSW09/2020__EPI_ISL_413595 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSFTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 562 - protein, 1273 aa, synthetic construct
  REGION 1..1273: note = SARS-CoV-2/Australia/NSW10/2020__EPI_ISL_413596 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 563 - protein, 1273 aa, synthetic construct
  REGION 1..1273: note SARS-CoV-2/Switzerland/1000477797/2020__EPI_ISL_413023 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 564 - protein, 1273 aa, synthetic construct
  REGION 1..1273: note = SARS-CoV-2/Belgium/BA-02291/2020__EPI_ISL_415159 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSAAPALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 565 - protein, 1273 aa, synthetic construct
  REGION 1..1273: note = SARS-CoV-2/USA/WA8-UW5/2020__EPI_ISL_413486 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 566 - protein, 1273 aa, synthetic construct
  REGION 1..1273: note = SARS-CoV-2/England/20102000506/2020__EPI_ISL_415147 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 567 - protein, 1273 aa, synthetic construct
  REGION 1..1273: note = SARS-CoV-2/Belgium/VAG-03013/2020__EPI_ISL_415155 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTATALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 568 - protein, 1273 aa, synthetic construct
  REGION 1..1273: note = SARS-CoV-2/Belgium/BC-03016/2020__EPI_ISL_415157 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTAPALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 569 - protein, 1273 aa, synthetic construct
  REGION 1..1273: note = SARS-CoV-2/Germany/BavPat3/2020__EPI_ISL_414521 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 570 - protein, 1273 aa, synthetic construct
  REGION 1..1273: note = SARS-CoV-2/France/HF1805/2020__EPI_ISL_414628 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 571 - protein, 1273 aa, synthetic construct
  REGION 1..1273: note SARS-CoV-2/Netherlands/ZuidHolland_9/2020__EPI_ISL_414445 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 572 - protein, 1273 aa, synthetic construct
  REGION 1..1273: note = SARS-CoV-2/Finland/FIN03032020A/2020__EPI_ISL_413602 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 573 - protein, 1273 aa, synthetic construct
  REGION 1..1273: note = SARS-CoV-2/France/GE1977/2020__EPI_ISL_414632 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLFSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 574 - protein, 1273 aa, synthetic construct
  REGION 1..1273: note = SARS-CoV-2/Finland/FIN-313/2020__EPI_ISL_414641 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 575 - protein, 1273 aa, synthetic construct
  REGION 1..1273: note SARS-CoV-2/Netherlands/ZuidHolland_2/2020__EPI_ISL_414556 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 576 - protein, 1273 aa, synthetic construct
  REGION 1..1273: note = SARS-CoV-2/USA/WA-UW31/2020__EPI_ISL_414618 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 577 - protein, 1273 aa, synthetic construct
  REGION 1..1273: note = SARS-CoV-2/South Korea/SNU01/2020__EPI_ISL_411929 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 578 - protein, 1273 aa, synthetic construct
  REGION 1..1273: note = SARS-CoV-2/China/WF0004/2020__EPI_ISL_413694 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRFDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 579 - protein, 1273 aa, synthetic construct
  REGION 1..1273: note = SARS-CoV-2/China/WF0028/2020__EPI_ISL_413791 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 580 - protein, 1273 aa, synthetic construct
  REGION 1..1273: note = SARS-CoV-2/2019-nCoV/USA-CruiseA-18/2020__MT159716.1 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 581 - protein, 1273 aa, synthetic construct
  REGION 1..1273: note SARS-CoV-2/SARS-CoV-2/Yunnan-01/human/2020/CHN__MT049951.1 spike protein (1-1273)(K986P_V987P_ H1048Q_H1064N_ H1083N_H1101N)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 582 - protein, 1273 aa, synthetic construct
  REGION 1..1273: note = SARS-CoV-2/USA/WA-UW292/2020__EPI_ISL_418077 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 583 - protein, 1273 aa, synthetic construct
  REGION 1..1273: note = SARS-CoV-2/Iceland/192/2020__EPI_ISL_417819 spike protein (1-1273)(K986P_V987P_ H1048Q_H1064N_ H1083N_H1101N)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 584 - protein, 1273 aa, synthetic construct
  REGION 1..1273: note = SARS-CoV-2/Belgium/ULG-6939/2020__EPI_ISL_417020 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 585 - protein, 1273 aa, synthetic construct
  REGION 1..1273: note = SARS-CoV-2/France/HF2496/2020__EPI_ISL_418231 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 586 - protein, 1273 aa, synthetic construct
  REGION 1..1273: note = SARS-CoV-2/USA/WA-UW291/2020__EPI_ISL_418076 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQYSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 587 - protein, 1273 aa, synthetic construct
  REGION 1..1273: note = SARS-CoV-2/Portugal/PT0034/2020__EPI_ISL_418019 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 588 - protein, 1273 aa, synthetic construct
  REGION 1..1273: note = SARS-CoV-2/Iceland/202/2020__EPI_ISL_417750 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 589 - protein, 1273 aa, synthetic construct
  REGION 1..1273: note = SARS-CoV-2/USA/WA-UW261/2020__EPI_ISL_418046 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 590 - protein, 1273 aa, synthetic construct
  REGION 1..1273: note = SARS-CoV-2/Portugal/PT0035/2020__EPI_ISL_418020 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 591 - protein, 1273 aa, synthetic construct
  REGION 1..1273: note = SARS-CoV-2/USA/NY-NYUMC7/2020__EPI_ISL_418192 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 592 - protein, 1273 aa, synthetic construct
  REGION 1..1273: note = SARS-CoV-2/Iceland/189/2020__EPI_ISL_417709 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 593 - protein, 1273 aa, synthetic construct
  REGION 1..1273: note = SARS-CoV-2/Australia/NSW56/2020__EPI_ISL_417408 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 594 - protein, 1273 aa, synthetic construct
  REGION 1..1273: note = SARS-CoV-2/Iceland/280/2020__EPI_ISL_417608 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 595 - protein, 1273 aa, synthetic construct
  REGION 1..1273: note = SARS-CoV-2/Iceland/247/2020__EPI_ISL_417575 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 596 - protein, 1273 aa, synthetic construct
  REGION 1..1273: note = SARS-CoV-2/Iceland/238/2020__EPI_ISL_417566 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 597 - protein, 1273 aa, synthetic construct
  REGION 1..1273: note = SARS-CoV-2/Greece/16/2020__EPI_ISL_418265 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 598 - protein, 1273 aa, synthetic construct
  REGION 1..1273: note = SARS-CoV-2/Iceland/319/2020__EPI_ISL_417648 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 599 - protein, 1273 aa, synthetic construct
  REGION 1..1273: note = SARS-CoV-2/Congo/94/2020__EPI_ISL_417947 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 600 - protein, 1273 aa, synthetic construct
  REGION 1..1273: note = SARS-CoV-2/Congo/158/2020__EPI_ISL_417950 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 601 - protein, 1273 aa, synthetic construct
  REGION 1..1273: note = SARS-CoV-2/USA/UT-00034/2020__EPI_ISL_417977 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 602 - protein, 1273 aa, synthetic construct
  REGION 1..1273: note = SARS-CoV-2/USA/UT-00033/2020__EPI_ISL_417976 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 603 - protein, 1273 aa, synthetic construct
  REGION 1..1273: note = SARS-CoV-2/USA/WI-13/2020__EPI_ISL_417516 spike protein (1-1273)(K986P_V987P_ H1048Q_H1064N_ H1083N_H1101N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 604 - protein, 1272 aa, synthetic construct
  REGION 1..1272: note = SARS-CoV-2/India/1-27/2020__EPI_ISL_413522 spike protein (1-1272)(K985P_V986P_ H1047Q_H1063N_ H1082N_H1100N)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNDGKAHFPREGVFVSNGTNWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 605 - protein, 1267 aa, synthetic construct
  REGION 1..1267: note = SARS-CoV-2/pangolin/Guangxi/P4L/2017__EPI_ISL_410538 spike protein (1-1267)(K980P_V981P_ H1042Q_H1058N_ H1077N_H1095N)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNEGKAHFPREGVFVSNGTNWFITQRNFYEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 606 - protein, 1267 aa, synthetic construct
  REGION 1..1267: note = SARS-CoV-2/pangolin/Guangxi/P5L/2017__EPI_ISL_410540 spike protein (1-1267)(K980P_V981P_ H1042Q_H1058N_ H1077N_H1095N)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNEGKAHFPREGVFVSNGTNWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 607 - protein, 1267 aa, synthetic construct
  REGION 1..1267: note = SARS-CoV-2/pangolin/Guangxi/P5E/2017__EPI_ISL_410541 spike protein (1-1267)(K980P_V981P_ H1042Q_H1058N_ H1077N_H1095N)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNEGKAHFPREGVFVSNGTNWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 608 - protein, 1265 aa, synthetic construct
  REGION 1..1265: note = SARS-CoV-2/pangolin/Guangxi/P1E/2017__EPI_ISL_410539 spike protein (1-1265)(K978P_V979P_ H1040Q_H1056N_ H1075N_H1093N)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYQLMSFPQSAPHGVVFLNVTYVPAQEKNFTTAPAICNEGKAHFPREGVFVSNGTNWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 609 - protein, 1273 aa, synthetic construct; identical to SEQ ID NO: 19
  REGION 1..1273: note = SARS-CoV-2/Wuhan/WIV05/2019__EPI_ISL_402128 spike protein (1-1273)(I712C_T1077C)

SEQ ID NO: 610 - protein, 1269 aa, synthetic construct
  REGION 1..1269: note = SARS-CoV-2/bat/Yunnan/RaTG13/2013__EPI_ISL_402131 spike protein (1-1269)(I708C_T1073C)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 611 - protein, 1273 aa, synthetic construct
  REGION 1..1273: note = SARS-CoV-2/Wuhan/HBCDC-HB-01/2019__EPI_ISL_402132 spike protein (1-1273)(I712C_T1077C)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 612 - protein, 1273 aa, synthetic construct
  REGION 1..1273: note = SARS-CoV-2/Guangdong/20SF028/2020__EPI_ISL_403936 spike protein (1-1273)(I712C_T1077C)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 613 - protein, 1273 aa, synthetic construct
  REGION 1..1273: note = SARS-CoV-2/Shenzhen/SZTH-001/2020__EPI_ISL_406592 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 614 - protein, 1273 aa, synthetic construct
  REGION 1..1273: note = SARS-CoV-2/Shenzhen/SZTH-004/2020__EPI_ISL_406595 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 615 - protein, 1273 aa, synthetic construct
  REGION 1..1273: note = SARS-CoV-2/France/IDF0372/2020__EPI_ISL_406596 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 616 - protein, 1273 aa, synthetic construct
  REGION 1..1273: note = SARS-CoV-2/Australia/VIC01/2020__EPI_ISL_406844 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 617 - protein, 1273 aa, synthetic construct
  REGION 1..1273: note = SARS-CoV-2/Germany/BavPat1/2020__EPI_ISL_406862 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 618 - protein, 1273 aa, synthetic construct
  REGION 1..1273: note = SARS-CoV-2/Wuhan/HBCDC-HB-02/2020__EPI_ISL_412978 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 619 - protein, 1273 aa, synthetic construct
  REGION 1..1273: note = SARS-CoV-2/Australia/QLD02/2020__EPI_ISL_407896 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 620 - protein, 1273 aa, synthetic construct
  REGION 1..1273: note = SARS-CoV-2/India/1-31/2020__EPI_ISL_413523 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 621 - protein, 1273 aa, synthetic construct
  REGION 1..1273: note SARS-CoV-2/Guangdong/GD2020087-P0008/2020__EPI_ISL_413863 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 622 - protein, 1273 aa, synthetic construct
  REGION 1..1273: note = SARS-CoV-2/Sweden/01/2020__EPI_ISL_411951 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 623 - protein, 1273 aa, synthetic construct
  REGION 1..1273: note = SARS-CoV-2/Tianmen/HBCDC-HB-07/2020__EPI_ISL_412983 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 624 - protein, 1273 aa, synthetic construct
  REGION 1..1273: note = SARS-CoV-2/Hong Kong/case42_VM20002493/2020__EPI_ISL_414527 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 625 - protein, 1273 aa, synthetic construct
  REGION 1..1273: note = SARS-CoV-2/USA/CruiseA-23/2020__EPI_ISL_414482 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 626 - protein, 1273 aa, synthetic construct
  REGION 1..1273: note = SARS-CoV-2/Hong Kong/case85_VM20002868/2020__EPI_ISL_414519 spike protein (1-1273)(I712C_T1077C)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 627 - protein, 1273 aa, synthetic construct
  REGION 1..1273: note = SARS-CoV-2/England/200990660/2020__EPI_ISL_414523 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 628 - protein, 1273 aa, synthetic construct
  REGION 1..1273: note = SARS-CoV-2/Australia/NSW09/2020__EPI_ISL_413595 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 629 - protein, 1273 aa, synthetic construct
  REGION 1..1273: note = SARS-CoV-2/Australia/NSW10/2020__EPI_ISL_413596 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 630 - protein, 1273 aa, synthetic construct
  REGION 1..1273: note SARS-CoV-2/Switzerland/1000477797/2020__EPI_ISL_413023 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 631 - protein, 1273 aa, synthetic construct
  REGION 1..1273: note = SARS-CoV-2/Belgium/BA-02291/2020__EPI_ISL_415159 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 632 - protein, 1273 aa, synthetic construct
  REGION 1..1273: note = SARS-CoV-2/USA/WA8-UW5/2020__EPI_ISL_413486 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 633 - protein, 1273 aa, synthetic construct
  REGION 1..1273: note = SARS-CoV-2/England/20102000506/2020__EPI_ISL_415147 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 634 - protein, 1273 aa, synthetic construct
  REGION 1..1273: note = SARS-CoV-2/Belgium/VAG-03013/2020__EPI_ISL_415155 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 635 - protein, 1273 aa, synthetic construct
  REGION 1..1273: note = SARS-CoV-2/Belgium/BC-03016/2020__EPI_ISL_415157 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 636 - protein, 1273 aa, synthetic construct
  REGION 1..1273: note = SARS-CoV-2/Germany/BavPat3/2020__EPI_ISL_414521 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 637 - protein, 1273 aa, synthetic construct
  REGION 1..1273: note = SARS-CoV-2/France/HF1805/2020__EPI_ISL_414628 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 638 - protein, 1273 aa, synthetic construct
  REGION 1..1273: note SARS-CoV-2/Netherlands/ZuidHolland_9/2020__EPI_ISL_414445 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 639 - protein, 1273 aa, synthetic construct
  REGION 1..1273: note = SARS-CoV-2/Finland/FIN03032020A/2020__EPI_ISL_413602 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 640 - protein, 1273 aa, synthetic construct
  REGION 1..1273: note = SARS-CoV-2/France/GE1977/2020__EPI_ISL_414632 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 641 - protein, 1273 aa, synthetic construct
  REGION 1..1273: note = SARS-CoV-2/Finland/FIN-313/2020__EPI_ISL_414641 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 642 - protein, 1273 aa, synthetic construct
  REGION 1..1273: note SARS-CoV-2/Netherlands/ZuidHolland_2/2020__EPI_ISL_414556 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 643 - protein, 1273 aa, synthetic construct
  REGION 1..1273: note = SARS-CoV-2/USA/WA-UW31/2020__EPI_ISL_414618 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 644 - protein, 1273 aa, synthetic construct
  REGION 1..1273: note = SARS-CoV-2/South Korea/SNU01/2020__EPI_ISL_411929 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 645 - protein, 1273 aa, synthetic construct
  REGION 1..1273: note = SARS-CoV-2/China/WF0004/2020__EPI_ISL_413694 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 646 - protein, 1273 aa, synthetic construct
  REGION 1..1273: note = SARS-CoV-2/China/WF0028/2020__EPI_ISL_413791 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 647 - protein, 1273 aa, synthetic construct
  REGION 1..1273: note = SARS-CoV-2/2019-nCoV/USA-CruiseA-18/2020__MT159716.1 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 648 - protein, 1273 aa, synthetic construct
  REGION 1..1273: note SARS-CoV-2/SARS-CoV-2/Yunnan-01/human/2020/CHN__MT049951.1 spike protein (1-1273)(I712C_T1077C)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 649 - protein, 1273 aa, synthetic construct
  REGION 1..1273: note = SARS-CoV-2/USA/WA-UW292/2020__EPI_ISL_418077 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 650 - protein, 1273 aa, synthetic construct
  REGION 1..1273: note = SARS-CoV-2/Iceland/192/2020__EPI_ISL_417819 spike protein (1-1273)(I712C_T1077C)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 651 - protein, 1273 aa, synthetic construct
  REGION 1..1273: note = SARS-CoV-2/Belgium/ULG-6939/2020__EPI_ISL_417020 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 652 - protein, 1273 aa, synthetic construct
  REGION 1..1273: note = SARS-CoV-2/France/HF2496/2020__EPI_ISL_418231 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 653 - protein, 1273 aa, synthetic construct
  REGION 1..1273: note = SARS-CoV-2/USA/WA-UW291/2020__EPI_ISL_418076 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 654 - protein, 1273 aa, synthetic construct
  REGION 1..1273: note = SARS-CoV-2/Portugal/PT0034/2020__EPI_ISL_418019 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 655 - protein, 1273 aa, synthetic construct
  REGION 1..1273: note = SARS-CoV-2/Iceland/202/2020__EPI_ISL_417750 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 656 - protein, 1273 aa, synthetic construct
  REGION 1..1273: note = SARS-CoV-2/USA/WA-UW261/2020__EPI_ISL_418046 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 657 - protein, 1273 aa, synthetic construct
  REGION 1..1273: note = SARS-CoV-2/Portugal/PT0035/2020__EPI_ISL_418020 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 658 - protein, 1273 aa, synthetic construct
  REGION 1..1273: note = SARS-CoV-2/USA/NY-NYUMC7/2020__EPI_ISL_418192 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 659 - protein, 1273 aa, synthetic construct
  REGION 1..1273: note = SARS-CoV-2/Iceland/189/2020__EPI_ISL_417709 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 660 - protein, 1273 aa, synthetic construct
  REGION 1..1273: note = SARS-CoV-2/Australia/NSW56/2020__EPI_ISL_417408 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 661 - protein, 1273 aa, synthetic construct
  REGION 1..1273: note = SARS-CoV-2/Iceland/280/2020__EPI_ISL_417608 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 662 - protein, 1273 aa, synthetic construct
  REGION 1..1273: note = SARS-CoV-2/Iceland/247/2020__EPI_ISL_417575 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 663 - protein, 1273 aa, synthetic construct
  REGION 1..1273: note = SARS-CoV-2/Iceland/238/2020__EPI_ISL_417566 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 664 - protein, 1273 aa, synthetic construct
  REGION 1..1273: note = SARS-CoV-2/Greece/16/2020__EPI_ISL_418265 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 665 - protein, 1273 aa, synthetic construct
  REGION 1..1273: note = SARS-CoV-2/Iceland/319/2020__EPI_ISL_417648 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 666 - protein, 1273 aa, synthetic construct
  REGION 1..1273: note = SARS-CoV-2/Congo/94/2020__EPI_ISL_417947 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 667 - protein, 1273 aa, synthetic construct
  REGION 1..1273: note = SARS-CoV-2/Congo/158/2020__EPI_ISL_417950 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 668 - protein, 1273 aa, synthetic construct
  REGION 1..1273: note = SARS-CoV-2/USA/UT-00034/2020__EPI_ISL_417977 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 669 - protein, 1273 aa, synthetic construct
  REGION 1..1273: note = SARS-CoV-2/USA/UT-00033/2020__EPI_ISL_417976 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 670 - protein, 1273 aa, synthetic construct
  REGION 1..1273: note = SARS-CoV-2/USA/WI-13/2020__EPI_ISL_417516 spike protein (1-1273)(I712C_T1077C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 671 - protein, 1272 aa, synthetic construct
  REGION 1..1272: note = SARS-CoV-2/India/1-27/2020__EPI_ISL_413522 spike protein (1-1272)(I711C_T1076C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSCAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 672 - protein, 1267 aa, synthetic construct
  REGION 1..1267: note = SARS-CoV-2/pangolin/Guangxi/P4L/2017__EPI_ISL_410538 spike protein (1-1267)(I706C_T1071C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSCAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 673 - protein, 1267 aa, synthetic construct
  REGION 1..1267: note = SARS-CoV-2/pangolin/Guangxi/P5L/2017__EPI_ISL_410540 spike protein (1-1267)(I706C_T1071C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSCAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 674 - protein, 1267 aa, synthetic construct
  REGION 1..1267: note = SARS-CoV-2/pangolin/Guangxi/P5E/2017__EPI_ISL_410541 spike protein (1-1267)(I706C_T1071C)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSCAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 675 - protein, 1265 aa, synthetic construct
  REGION 1..1265: note = SARS-CoV-2/pangolin/Guangxi/P1E/2017__EPI_ISL_410539 spike protein (1-1265)(I704C_T1069C)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSCAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTCAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 676 - protein, 1273 aa, synthetic construct; identical to SEQ ID NO: 20
  REGION 1..1273: note = SARS-CoV-2/Wuhan/WIV05/2019__EPI_ISL_402128 spike protein (1-1273)(I714C_Y1110C)

SEQ ID NO: 677 - protein, 1269 aa, synthetic construct
  REGION 1..1269: note = SARS-CoV-2/bat/Yunnan/RaTG13/2013__EPI_ISL_402131 spike protein (1-1269)(I710C_Y1106C)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 678 - protein, 1273 aa, synthetic construct
  REGION 1..1273: note = SARS-CoV-2/Wuhan/HBCDC-HB-01/2019__EPI_ISL_402132 spike protein (1-1273)(I714C_Y1110C)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 679 - protein, 1273 aa, synthetic construct
  REGION 1..1273: note = SARS-CoV-2/Guangdong/20SF028/2020__EPI_ISL_403936 spike protein (1-1273)(I714C_Y1110C)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 680 - protein, 1273 aa, synthetic construct
  REGION 1..1273: note = SARS-CoV-2/Shenzhen/SZTH-001/2020__EPI_ISL_406592 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 681 - protein, 1273 aa, synthetic construct
  REGION 1..1273: note = SARS-CoV-2/Shenzhen/SZTH-004/2020__EPI_ISL_406595 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 682 - protein, 1273 aa, synthetic construct
  REGION 1..1273: note = SARS-CoV-2/France/IDF0372/2020__EPI_ISL_406596 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 683 - protein, 1273 aa, synthetic construct
  REGION 1..1273: note = SARS-CoV-2/Australia/VIC01/2020__EPI_ISL_406844 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 684 - protein, 1273 aa, synthetic construct
  REGION 1..1273: note = SARS-CoV-2/Germany/BavPat1/2020__EPI_ISL_406862 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 685 - protein, 1273 aa, synthetic construct
  REGION 1..1273: note = SARS-CoV-2/Wuhan/HBCDC-HB-02/2020__EPI_ISL_412978 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 686 - protein, 1273 aa, synthetic construct
  REGION 1..1273: note = SARS-CoV-2/Australia/QLD02/2020__EPI_ISL_407896 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 687 - protein, 1273 aa, synthetic construct
  REGION 1..1273: note = SARS-CoV-2/India/1-31/2020__EPI_ISL_413523 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 688 - protein, 1273 aa, synthetic construct
  REGION 1..1273: note SARS-CoV-2/Guangdong/GD2020087-P0008/2020__EPI_ISL_413863 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 689 - protein, 1273 aa, synthetic construct
  REGION 1..1273: note = SARS-CoV-2/Sweden/01/2020__EPI_ISL_411951 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 690 - protein, 1273 aa, synthetic construct
  REGION 1..1273: note = SARS-CoV-2/Tianmen/HBCDC-HB-07/2020__EPI_ISL_412983 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 691 - protein, 1273 aa, synthetic construct
  REGION 1..1273: note = SARS-CoV-2/Hong Kong/case42_VM20002493/2020__EPI_ISL_414527 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 692 - protein, 1273 aa, synthetic construct
  REGION 1..1273: note = SARS-CoV-2/USA/CruiseA-23/2020__EPI_ISL_414482 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 693 - protein, 1273 aa, synthetic construct
  REGION 1..1273: note = SARS-CoV-2/Hong Kong/case85_VM20002868/2020__EPI_ISL_414519 spike protein (1-1273)(I714C_Y1110C)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 694 - protein, 1273 aa, synthetic construct
  REGION 1..1273: note = SARS-CoV-2/England/200990660/2020__EPI_ISL_414523 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 695 - protein, 1273 aa, synthetic construct
  REGION 1..1273: note = SARS-CoV-2/Australia/NSW09/2020__EPI_ISL_413595 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 696 - protein, 1273 aa, synthetic construct
  REGION 1..1273: note = SARS-CoV-2/Australia/NSW10/2020__EPI_ISL_413596 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 697 - protein, 1273 aa, synthetic construct
  REGION 1..1273: note SARS-CoV-2/Switzerland/1000477797/2020__EPI_ISL_413023 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 698 - protein, 1273 aa, synthetic construct
  REGION 1..1273: note = SARS-CoV-2/Belgium/BA-02291/2020__EPI_ISL_415159 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 699 - protein, 1273 aa, synthetic construct
  REGION 1..1273: note = SARS-CoV-2/USA/WA8-UW5/2020__EPI_ISL_413486 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 700 - protein, 1273 aa, synthetic construct
  REGION 1..1273: note = SARS-CoV-2/England/20102000506/2020__EPI_ISL_415147 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 701 - protein, 1273 aa, synthetic construct
  REGION 1..1273: note = SARS-CoV-2/Belgium/VAG-03013/2020__EPI_ISL_415155 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 702 - protein, 1273 aa, synthetic construct
  REGION 1..1273: note = SARS-CoV-2/Belgium/BC-03016/2020__EPI_ISL_415157 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 703 - protein, 1273 aa, synthetic construct
  REGION 1..1273: note = SARS-CoV-2/Germany/BavPat3/2020__EPI_ISL_414521 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 704 - protein, 1273 aa, synthetic construct
  REGION 1..1273: note = SARS-CoV-2/France/HF1805/2020__EPI_ISL_414628 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 705 - protein, 1273 aa, synthetic construct
  REGION 1..1273: note SARS-CoV-2/Netherlands/ZuidHolland_9/2020__EPI_ISL_414445 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 706 - protein, 1273 aa, synthetic construct
  REGION 1..1273: note = SARS-CoV-2/Finland/FIN03032020A/2020__EPI_ISL_413602 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 707 - protein, 1273 aa, synthetic construct
  REGION 1..1273: note = SARS-CoV-2/France/GE1977/2020__EPI_ISL_414632 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 708 - protein, 1273 aa, synthetic construct
  REGION 1..1273: note = SARS-CoV-2/Finland/FIN-313/2020__EPI_ISL_414641 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 709 - protein, 1273 aa, synthetic construct
  REGION 1..1273: note SARS-CoV-2/Netherlands/ZuidHolland_2/2020__EPI_ISL_414556 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 710 - protein, 1273 aa, synthetic construct
  REGION 1..1273: note = SARS-CoV-2/USA/WA-UW31/2020__EPI_ISL_414618 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 711 - protein, 1273 aa, synthetic construct
  REGION 1..1273: note = SARS-CoV-2/South Korea/SNU01/2020__EPI_ISL_411929 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 712 - protein, 1273 aa, synthetic construct
  REGION 1..1273: note = SARS-CoV-2/China/WF0004/2020__EPI_ISL_413694 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 713 - protein, 1273 aa, synthetic construct
  REGION 1..1273: note = SARS-CoV-2/China/WF0028/2020__EPI_ISL_413791 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 714 - protein, 1273 aa, synthetic construct
  REGION 1..1273: note = SARS-CoV-2/2019-nCoV/USA-CruiseA-18/2020__MT159716.1 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 715 - protein, 1273 aa, synthetic construct
  REGION 1..1273: note SARS-CoV-2/SARS-CoV-2/Yunnan-01/human/2020/CHN__MT049951.1 spike protein (1-1273)(I714C_Y1110C)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 716 - protein, 1273 aa, synthetic construct
  REGION 1..1273: note = SARS-CoV-2/USA/WA-UW292/2020__EPI_ISL_418077 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 717 - protein, 1273 aa, synthetic construct
  REGION 1..1273: note = SARS-CoV-2/Iceland/192/2020__EPI_ISL_417819 spike protein (1-1273)(I714C_Y1110C)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 718 - protein, 1273 aa, synthetic construct
  REGION 1..1273: note = SARS-CoV-2/Belgium/ULG-6939/2020__EPI_ISL_417020 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 719 - protein, 1273 aa, synthetic construct
  REGION 1..1273: note = SARS-CoV-2/France/HF2496/2020__EPI_ISL_418231 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 720 - protein, 1273 aa, synthetic construct
  REGION 1..1273: note = SARS-CoV-2/USA/WA-UW291/2020__EPI_ISL_418076 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 721 - protein, 1273 aa, synthetic construct
  REGION 1..1273: note = SARS-CoV-2/Portugal/PT0034/2020__EPI_ISL_418019 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 722 - protein, 1273 aa, synthetic construct
  REGION 1..1273: note = SARS-CoV-2/Iceland/202/2020__EPI_ISL_417750 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 723 - protein, 1273 aa, synthetic construct
  REGION 1..1273: note = SARS-CoV-2/USA/WA-UW261/2020__EPI_ISL_418046 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 724 - protein, 1273 aa, synthetic construct
  REGION 1..1273: note = SARS-CoV-2/Portugal/PT0035/2020__EPI_ISL_418020 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 725 - protein, 1273 aa, synthetic construct
  REGION 1..1273: note = SARS-CoV-2/USA/NY-NYUMC7/2020__EPI_ISL_418192 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 726 - protein, 1273 aa, synthetic construct
  REGION 1..1273: note = SARS-CoV-2/Iceland/189/2020__EPI_ISL_417709 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 727 - protein, 1273 aa, synthetic construct
  REGION 1..1273: note = SARS-CoV-2/Australia/NSW56/2020__EPI_ISL_417408 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 728 - protein, 1273 aa, synthetic construct
  REGION 1..1273: note = SARS-CoV-2/Iceland/280/2020__EPI_ISL_417608 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 729 - protein, 1273 aa, synthetic construct
  REGION 1..1273: note = SARS-CoV-2/Iceland/247/2020__EPI_ISL_417575 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 730 - protein, 1273 aa, synthetic construct
  REGION 1..1273: note = SARS-CoV-2/Iceland/238/2020__EPI_ISL_417566 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 731 - protein, 1273 aa, synthetic construct
  REGION 1..1273: note = SARS-CoV-2/Greece/16/2020__EPI_ISL_418265 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 732 - protein, 1273 aa, synthetic construct
  REGION 1..1273: note = SARS-CoV-2/Iceland/319/2020__EPI_ISL_417648 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 733 - protein, 1273 aa, synthetic construct
  REGION 1..1273: note = SARS-CoV-2/Congo/94/2020__EPI_ISL_417947 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 734 - protein, 1273 aa, synthetic construct
  REGION 1..1273: note = SARS-CoV-2/Congo/158/2020__EPI_ISL_417950 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 735 - protein, 1273 aa, synthetic construct
  REGION 1..1273: note = SARS-CoV-2/USA/UT-00034/2020__EPI_ISL_417977 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 736 - protein, 1273 aa, synthetic construct
  REGION 1..1273: note = SARS-CoV-2/USA/UT-00033/2020__EPI_ISL_417976 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 737 - protein, 1273 aa, synthetic construct
  REGION 1..1273: note = SARS-CoV-2/USA/WI-13/2020__EPI_ISL_417516 spike protein (1-1273)(I714C_Y1110C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 738 - protein, 1272 aa, synthetic construct
  REGION 1..1272: note = SARS-CoV-2/India/1-27/2020__EPI_ISL_413522 spike protein (1-1272)(I713C_Y1109C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIACPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFCEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 739 - protein, 1267 aa, synthetic construct
  REGION 1..1267: note = SARS-CoV-2/pangolin/Guangxi/P4L/2017__EPI_ISL_410538 spike protein (1-1267)(I708C_Y1104C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIACPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFCEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 740 - protein, 1267 aa, synthetic construct
  REGION 1..1267: note = SARS-CoV-2/pangolin/Guangxi/P5L/2017__EPI_ISL_410540 spike protein (1-1267)(I708C_Y1104C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIACPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFCEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 741 - protein, 1267 aa, synthetic construct
  REGION 1..1267: note = SARS-CoV-2/pangolin/Guangxi/P5E/2017__EPI_ISL_410541 spike protein (1-1267)(I708C_Y1104C)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIACPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFCEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 742 - protein, 1265 aa, synthetic construct
  REGION 1..1265: note = SARS-CoV-2/pangolin/Guangxi/P1E/2017__EPI_ISL_410539 spike protein (1-1265)(I706C_Y1102C)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIACPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFCEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 743 - protein, 1273 aa, synthetic construct; identical to SEQ ID NO: 21
  REGION 1..1273: note = SARS-CoV-2/Wuhan/WIV05/2019__EPI_ISL_402128 spike protein (1-1273)(P715C_P1069C)

SEQ ID NO: 744 - protein, 1269 aa, synthetic construct
  REGION 1..1269: note = SARS-CoV-2/bat/Yunnan/RaTG13/2013__EPI_ISL_402131 spike protein (1-1269)(P711C_P1065C)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 745 - protein, 1273 aa, synthetic construct
  REGION 1..1273: note = SARS-CoV-2/Wuhan/HBCDC-HB-01/2019__EPI_ISL_402132 spike protein (1-1273)(P715C_P1069C)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 746 - protein, 1273 aa, synthetic construct
  REGION 1..1273: note = SARS-CoV-2/Guangdong/20SF028/2020__EPI_ISL_403936 spike protein (1-1273)(P715C_P1069C)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 747 - protein, 1273 aa, synthetic construct
  REGION 1..1273: note = SARS-CoV-2/Shenzhen/SZTH-001/2020__EPI_ISL_406592 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 748 - protein, 1273 aa, synthetic construct
  REGION 1..1273: note = SARS-CoV-2/Shenzhen/SZTH-004/2020__EPI_ISL_406595 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 749 - protein, 1273 aa, synthetic construct
  REGION 1..1273: note = SARS-CoV-2/France/IDF0372/2020__EPI_ISL_406596 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 750 - protein, 1273 aa, synthetic construct
  REGION 1..1273: note = SARS-CoV-2/Australia/VIC01/2020__EPI_ISL_406844 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 751 - protein, 1273 aa, synthetic construct
  REGION 1..1273: note = SARS-CoV-2/Germany/BavPat1/2020__EPI_ISL_406862 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 752 - protein, 1273 aa, synthetic construct
  REGION 1..1273: note = SARS-CoV-2/Wuhan/HBCDC-HB-02/2020__EPI_ISL_412978 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 753 - protein, 1273 aa, synthetic construct
  REGION 1..1273: note = SARS-CoV-2/Australia/QLD02/2020__EPI_ISL_407896 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 754 - protein, 1273 aa, synthetic construct
  REGION 1..1273: note = SARS-CoV-2/India/1-31/2020__EPI_ISL_413523 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 755 - protein, 1273 aa, synthetic construct
  REGION 1..1273: note SARS-CoV-2/Guangdong/GD2020087-P0008/2020__EPI_ISL_413863 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 756 - protein, 1273 aa, synthetic construct
  REGION 1..1273: note = SARS-CoV-2/Sweden/01/2020__EPI_ISL_411951 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 757 - protein, 1273 aa, synthetic construct
  REGION 1..1273: note = SARS-CoV-2/Tianmen/HBCDC-HB-07/2020__EPI_ISL_412983 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 758 - protein, 1273 aa, synthetic construct
  REGION 1..1273: note = SARS-CoV-2/Hong Kong/case42_VM20002493/2020__EPI_ISL_414527 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 759 - protein, 1273 aa, synthetic construct
  REGION 1..1273: note = SARS-CoV-2/USA/CruiseA-23/2020__EPI_ISL_414482 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 760 - protein, 1273 aa, synthetic construct
  REGION 1..1273: note = SARS-CoV-2/Hong Kong/case85_VM20002868/2020__EPI_ISL_414519 spike protein (1-1273)(P715C_P1069C)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 761 - protein, 1273 aa, synthetic construct
  REGION 1..1273: note = SARS-CoV-2/England/200990660/2020__EPI_ISL_414523 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 762 - protein, 1273 aa, synthetic construct
  REGION 1..1273: note = SARS-CoV-2/Australia/NSW09/2020__EPI_ISL_413595 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 763 - protein, 1273 aa, synthetic construct
  REGION 1..1273: note = SARS-CoV-2/Australia/NSW10/2020__EPI_ISL_413596 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 764 - protein, 1273 aa, synthetic construct
  REGION 1..1273: note SARS-CoV-2/Switzerland/1000477797/2020__EPI_ISL_413023 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 765 - protein, 1273 aa, synthetic construct
  REGION 1..1273: note = SARS-CoV-2/Belgium/BA-02291/2020__EPI_ISL_415159 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 766 - protein, 1273 aa, synthetic construct
  REGION 1..1273: note = SARS-CoV-2/USA/WA8-UW5/2020__EPI_ISL_413486 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 767 - protein, 1273 aa, synthetic construct
  REGION 1..1273: note = SARS-CoV-2/England/20102000506/2020__EPI_ISL_415147 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 768 - protein, 1273 aa, synthetic construct
  REGION 1..1273: note = SARS-CoV-2/Belgium/VAG-03013/2020__EPI_ISL_415155 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 769 - protein, 1273 aa, synthetic construct
  REGION 1..1273: note = SARS-CoV-2/Belgium/BC-03016/2020__EPI_ISL_415157 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 770 - protein, 1273 aa, synthetic construct
  REGION 1..1273: note = SARS-CoV-2/Germany/BavPat3/2020__EPI_ISL_414521 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 771 - protein, 1273 aa, synthetic construct
  REGION 1..1273: note = SARS-CoV-2/France/HF1805/2020__EPI_ISL_414628 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 772 - protein, 1273 aa, synthetic construct
  REGION 1..1273: note SARS-CoV-2/Netherlands/ZuidHolland_9/2020__EPI_ISL_414445 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 773 - protein, 1273 aa, synthetic construct
  REGION 1..1273: note = SARS-CoV-2/Finland/FIN03032020A/2020__EPI_ISL_413602 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 774 - protein, 1273 aa, synthetic construct
  REGION 1..1273: note = SARS-CoV-2/France/GE1977/2020__EPI_ISL_414632 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 775 - protein, 1273 aa, synthetic construct
  REGION 1..1273: note = SARS-CoV-2/Finland/FIN-313/2020__EPI_ISL_414641 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 776 - protein, 1273 aa, synthetic construct
  REGION 1..1273: note SARS-CoV-2/Netherlands/ZuidHolland_2/2020__EPI_ISL_414556 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 777 - protein, 1273 aa, synthetic construct
  REGION 1..1273: note = SARS-CoV-2/USA/WA-UW31/2020__EPI_ISL_414618 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 778 - protein, 1273 aa, synthetic construct
  REGION 1..1273: note = SARS-CoV-2/South Korea/SNU01/2020__EPI_ISL_411929 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 779 - protein, 1273 aa, synthetic construct
  REGION 1..1273: note = SARS-CoV-2/China/WF0004/2020__EPI_ISL_413694 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 780 - protein, 1273 aa, synthetic construct
  REGION 1..1273: note = SARS-CoV-2/China/WF0028/2020__EPI_ISL_413791 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 781 - protein, 1273 aa, synthetic construct
  REGION 1..1273: note = SARS-CoV-2/2019-nCoV/USA-CruiseA-18/2020__MT159716.1 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 782 - protein, 1273 aa, synthetic construct
  REGION 1..1273: note SARS-CoV-2/SARS-CoV-2/Yunnan-01/human/2020/CHN__MT049951.1 spike protein (1-1273)(P715C_P1069C)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 783 - protein, 1273 aa, synthetic construct
  REGION 1..1273: note = SARS-CoV-2/USA/WA-UW292/2020__EPI_ISL_418077 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 784 - protein, 1273 aa, synthetic construct
  REGION 1..1273: note = SARS-CoV-2/Iceland/192/2020__EPI_ISL_417819 spike protein (1-1273)(P715C_P1069C)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 785 - protein, 1273 aa, synthetic construct
  REGION 1..1273: note = SARS-CoV-2/Belgium/ULG-6939/2020__EPI_ISL_417020 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 786 - protein, 1273 aa, synthetic construct
  REGION 1..1273: note = SARS-CoV-2/France/HF2496/2020__EPI_ISL_418231 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 787 - protein, 1273 aa, synthetic construct
  REGION 1..1273: note = SARS-CoV-2/USA/WA-UW291/2020__EPI_ISL_418076 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 788 - protein, 1273 aa, synthetic construct
  REGION 1..1273: note = SARS-CoV-2/Portugal/PT0034/2020__EPI_ISL_418019 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 789 - protein, 1273 aa, synthetic construct
  REGION 1..1273: note = SARS-CoV-2/Iceland/202/2020__EPI_ISL_417750 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 790 - protein, 1273 aa, synthetic construct
  REGION 1..1273: note = SARS-CoV-2/USA/WA-UW261/2020__EPI_ISL_418046 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 791 - protein, 1273 aa, synthetic construct
  REGION 1..1273: note = SARS-CoV-2/Portugal/PT0035/2020__EPI_ISL_418020 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 792 - protein, 1273 aa, synthetic construct
  REGION 1..1273: note = SARS-CoV-2/USA/NY-NYUMC7/2020__EPI_ISL_418192 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 793 - protein, 1273 aa, synthetic construct
  REGION 1..1273: note = SARS-CoV-2/Iceland/189/2020__EPI_ISL_417709 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 794 - protein, 1273 aa, synthetic construct
  REGION 1..1273: note = SARS-CoV-2/Australia/NSW56/2020__EPI_ISL_417408 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 795 - protein, 1273 aa, synthetic construct
  REGION 1..1273: note = SARS-CoV-2/Iceland/280/2020__EPI_ISL_417608 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 796 - protein, 1273 aa, synthetic construct
  REGION 1..1273: note = SARS-CoV-2/Iceland/247/2020__EPI_ISL_417575 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 797 - protein, 1273 aa, synthetic construct
  REGION 1..1273: note = SARS-CoV-2/Iceland/238/2020__EPI_ISL_417566 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 798 - protein, 1273 aa, synthetic construct
  REGION 1..1273: note = SARS-CoV-2/Greece/16/2020__EPI_ISL_418265 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 799 - protein, 1273 aa, synthetic construct
  REGION 1..1273: note = SARS-CoV-2/Iceland/319/2020__EPI_ISL_417648 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 800 - protein, 1273 aa, synthetic construct
  REGION 1..1273: note = SARS-CoV-2/Congo/94/2020__EPI_ISL_417947 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 801 - protein, 1273 aa, synthetic construct
  REGION 1..1273: note = SARS-CoV-2/Congo/158/2020__EPI_ISL_417950 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 802 - protein, 1273 aa, synthetic construct
  REGION 1..1273: note = SARS-CoV-2/USA/UT-00034/2020__EPI_ISL_417977 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 803 - protein, 1273 aa, synthetic construct
  REGION 1..1273: note = SARS-CoV-2/USA/UT-00033/2020__EPI_ISL_417976 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 804 - protein, 1273 aa, synthetic construct
  REGION 1..1273: note = SARS-CoV-2/USA/WI-13/2020__EPI_ISL_417516 spike protein (1-1273)(P715C_P1069C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 805 - protein, 1272 aa, synthetic construct
  REGION 1..1272: note = SARS-CoV-2/India/1-27/2020__EPI_ISL_413522 spike protein (1-1272)(P714C_P1068C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAICTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 806 - protein, 1267 aa, synthetic construct
  REGION 1..1267: note = SARS-CoV-2/pangolin/Guangxi/P4L/2017__EPI_ISL_410538 spike protein (1-1267)(P709C_P1063C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAICTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 807 - protein, 1267 aa, synthetic construct
  REGION 1..1267: note = SARS-CoV-2/pangolin/Guangxi/P5L/2017__EPI_ISL_410540 spike protein (1-1267)(P709C_P1063C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAICTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 808 - protein, 1267 aa, synthetic construct
  REGION 1..1267: note = SARS-CoV-2/pangolin/Guangxi/P5E/2017__EPI_ISL_410541 spike protein (1-1267)(P709C_P1063C)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAICTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 809 - protein, 1265 aa, synthetic construct
  REGION 1..1265: note = SARS-CoV-2/pangolin/Guangxi/P1E/2017__EPI_ISL_410539 spike protein (1-1265)(P707C_P1061C)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAICTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVCAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 810 - protein, 1273 aa, synthetic construct; identical to SEQ ID NO: 22
  REGION 1..1273: note = SARS-CoV-2/Wuhan/WIV05/2019__EPI_ISL_402128 spike protein (1-1273)(G889C_L1034C)

SEQ ID NO: 811 - protein, 1269 aa, synthetic construct
  REGION 1..1269: note = SARS-CoV-2/bat/Yunnan/RaTG13/2013__EPI_ISL_402131 spike protein (1-1269)(G885C_L1030C)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 812 - protein, 1273 aa, synthetic construct
  REGION 1..1273: note = SARS-CoV-2/Wuhan/HBCDC-HB-01/2019__EPI_ISL_402132 spike protein (1-1273)(G889C_L1034C)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 813 - protein, 1273 aa, synthetic construct
  REGION 1..1273: note = SARS-CoV-2/Guangdong/20SF028/2020__EPI_ISL_403936 spike protein (1-1273)(G889C_L1034C)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 814 - protein, 1273 aa, synthetic construct
  REGION 1..1273: note = SARS-CoV-2/Shenzhen/SZTH-001/2020__EPI_ISL_406592 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 815 - protein, 1273 aa, synthetic construct
  REGION 1..1273: note = SARS-CoV-2/Shenzhen/SZTH-004/2020__EPI_ISL_406595 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 816 - protein, 1273 aa, synthetic construct
  REGION 1..1273: note = SARS-CoV-2/France/IDF0372/2020__EPI_ISL_406596 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 817 - protein, 1273 aa, synthetic construct
  REGION 1..1273: note = SARS-CoV-2/Australia/VIC01/2020__EPI_ISL_406844 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 818 - protein, 1273 aa, synthetic construct
  REGION 1..1273: note = SARS-CoV-2/Germany/BavPat1/2020__EPI_ISL_406862 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 819 - protein, 1273 aa, synthetic construct
  REGION 1..1273: note = SARS-CoV-2/Wuhan/HBCDC-HB-02/2020__EPI_ISL_412978 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 820 - protein, 1273 aa, synthetic construct
  REGION 1..1273: note = SARS-CoV-2/Australia/QLD02/2020__EPI_ISL_407896 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 821 - protein, 1273 aa, synthetic construct
  REGION 1..1273: note = SARS-CoV-2/India/1-31/2020__EPI_ISL_413523 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 822 - protein, 1273 aa, synthetic construct
  REGION 1..1273: note SARS-CoV-2/Guangdong/GD2020087-P0008/2020__EPI_ISL_413863 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 823 - protein, 1273 aa, synthetic construct
  REGION 1..1273: note = SARS-CoV-2/Sweden/01/2020__EPI_ISL_411951 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 824 - protein, 1273 aa, synthetic construct
  REGION 1..1273: note = SARS-CoV-2/Tianmen/HBCDC-HB-07/2020__EPI_ISL_412983 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 825 - protein, 1273 aa, synthetic construct
  REGION 1..1273: note = SARS-CoV-2/Hong Kong/case42_VM20002493/2020__EPI_ISL_414527 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 826 - protein, 1273 aa, synthetic construct
  REGION 1..1273: note = SARS-CoV-2/USA/CruiseA-23/2020__EPI_ISL_414482 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 827 - protein, 1273 aa, synthetic construct
  REGION 1..1273: note = SARS-CoV-2/Hong Kong/case85_VM20002868/2020__EPI_ISL_414519 spike protein (1-1273)(G889C_L1034C)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 828 - protein, 1273 aa, synthetic construct
  REGION 1..1273: note = SARS-CoV-2/England/200990660/2020__EPI_ISL_414523 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 829 - protein, 1273 aa, synthetic construct
  REGION 1..1273: note = SARS-CoV-2/Australia/NSW09/2020__EPI_ISL_413595 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 830 - protein, 1273 aa, synthetic construct
  REGION 1..1273: note = SARS-CoV-2/Australia/NSW10/2020__EPI_ISL_413596 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 831 - protein, 1273 aa, synthetic construct
  REGION 1..1273: note SARS-CoV-2/Switzerland/1000477797/2020__EPI_ISL_413023 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 832 - protein, 1273 aa, synthetic construct
  REGION 1..1273: note = SARS-CoV-2/Belgium/BA-02291/2020__EPI_ISL_415159 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 833 - protein, 1273 aa, synthetic construct
  REGION 1..1273: note = SARS-CoV-2/USA/WA8-UW5/2020__EPI_ISL_413486 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 834 - protein, 1273 aa, synthetic construct
  REGION 1..1273: note = SARS-CoV-2/England/20102000506/2020__EPI_ISL_415147 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 835 - protein, 1273 aa, synthetic construct
  REGION 1..1273: note = SARS-CoV-2/Belgium/VAG-03013/2020__EPI_ISL_415155 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 836 - protein, 1273 aa, synthetic construct
  REGION 1..1273: note = SARS-CoV-2/Belgium/BC-03016/2020__EPI_ISL_415157 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 837 - protein, 1273 aa, synthetic construct
  REGION 1..1273: note = SARS-CoV-2/Germany/BavPat3/2020__EPI_ISL_414521 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 838 - protein, 1273 aa, synthetic construct
  REGION 1..1273: note = SARS-CoV-2/France/HF1805/2020__EPI_ISL_414628 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 839 - protein, 1273 aa, synthetic construct
  REGION 1..1273: note SARS-CoV-2/Netherlands/ZuidHolland_9/2020__EPI_ISL_414445 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 840 - protein, 1273 aa, synthetic construct
  REGION 1..1273: note = SARS-CoV-2/Finland/FIN03032020A/2020__EPI_ISL_413602 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 841 - protein, 1273 aa, synthetic construct
  REGION 1..1273: note = SARS-CoV-2/France/GE1977/2020__EPI_ISL_414632 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 842 - protein, 1273 aa, synthetic construct
  REGION 1..1273: note = SARS-CoV-2/Finland/FIN-313/2020__EPI_ISL_414641 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 843 - protein, 1273 aa, synthetic construct
  REGION 1..1273: note SARS-CoV-2/Netherlands/ZuidHolland_2/2020__EPI_ISL_414556 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 844 - protein, 1273 aa, synthetic construct
  REGION 1..1273: note = SARS-CoV-2/USA/WA-UW31/2020__EPI_ISL_414618 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 845 - protein, 1273 aa, synthetic construct
  REGION 1..1273: note = SARS-CoV-2/South Korea/SNU01/2020__EPI_ISL_411929 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 846 - protein, 1273 aa, synthetic construct
  REGION 1..1273: note = SARS-CoV-2/China/WF0004/2020__EPI_ISL_413694 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRFDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 847 - protein, 1273 aa, synthetic construct
  REGION 1..1273: note = SARS-CoV-2/China/WF0028/2020__EPI_ISL_413791 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 848 - protein, 1273 aa, synthetic construct
  REGION 1..1273: note = SARS-CoV-2/2019-nCoV/USA-CruiseA-18/2020__MT159716.1 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 849 - protein, 1273 aa, synthetic construct
  REGION 1..1273: note SARS-CoV-2/SARS-CoV-2/Yunnan-01/human/2020/CHN__MT049951.1 spike protein (1-1273)(G889C_L1034C)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 850 - protein, 1273 aa, synthetic construct
  REGION 1..1273: note = SARS-CoV-2/USA/WA-UW292/2020__EPI_ISL_418077 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 851 - protein, 1273 aa, synthetic construct
  REGION 1..1273: note = SARS-CoV-2/Iceland/192/2020__EPI_ISL_417819 spike protein (1-1273)(G889C_L1034C)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 852 - protein, 1273 aa, synthetic construct
  REGION 1..1273: note = SARS-CoV-2/Belgium/ULG-6939/2020__EPI_ISL_417020 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 853 - protein, 1273 aa, synthetic construct
  REGION 1..1273: note = SARS-CoV-2/France/HF2496/2020__EPI_ISL_418231 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 854 - protein, 1273 aa, synthetic construct
  REGION 1..1273: note = SARS-CoV-2/USA/WA-UW291/2020__EPI_ISL_418076 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 855 - protein, 1273 aa, synthetic construct
  REGION 1..1273: note = SARS-CoV-2/Portugal/PT0034/2020__EPI_ISL_418019 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 856 - protein, 1273 aa, synthetic construct
  REGION 1..1273: note = SARS-CoV-2/Iceland/202/2020__EPI_ISL_417750 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 857 - protein, 1273 aa, synthetic construct
  REGION 1..1273: note = SARS-CoV-2/USA/WA-UW261/2020__EPI_ISL_418046 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 858 - protein, 1273 aa, synthetic construct
  REGION 1..1273: note = SARS-CoV-2/Portugal/PT0035/2020__EPI_ISL_418020 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 859 - protein, 1273 aa, synthetic construct
  REGION 1..1273: note = SARS-CoV-2/USA/NY-NYUMC7/2020__EPI_ISL_418192 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 860 - protein, 1273 aa, synthetic construct
  REGION 1..1273: note = SARS-CoV-2/Iceland/189/2020__EPI_ISL_417709 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 861 - protein, 1273 aa, synthetic construct
  REGION 1..1273: note = SARS-CoV-2/Australia/NSW56/2020__EPI_ISL_417408 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 862 - protein, 1273 aa, synthetic construct
  REGION 1..1273: note = SARS-CoV-2/Iceland/280/2020__EPI_ISL_417608 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 863 - protein, 1273 aa, synthetic construct
  REGION 1..1273: note = SARS-CoV-2/Iceland/247/2020__EPI_ISL_417575 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 864 - protein, 1273 aa, synthetic construct
  REGION 1..1273: note = SARS-CoV-2/Iceland/238/2020__EPI_ISL_417566 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 865 - protein, 1273 aa, synthetic construct
  REGION 1..1273: note = SARS-CoV-2/Greece/16/2020__EPI_ISL_418265 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 866 - protein, 1273 aa, synthetic construct
  REGION 1..1273: note = SARS-CoV-2/Iceland/319/2020__EPI_ISL_417648 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 867 - protein, 1273 aa, synthetic construct
  REGION 1..1273: note = SARS-CoV-2/Congo/94/2020__EPI_ISL_417947 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 868 - protein, 1273 aa, synthetic construct
  REGION 1..1273: note = SARS-CoV-2/Congo/158/2020__EPI_ISL_417950 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 869 - protein, 1273 aa, synthetic construct
  REGION 1..1273: note = SARS-CoV-2/USA/UT-00034/2020__EPI_ISL_417977 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 870 - protein, 1273 aa, synthetic construct
  REGION 1..1273: note = SARS-CoV-2/USA/UT-00033/2020__EPI_ISL_417976 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 871 - protein, 1273 aa, synthetic construct
  REGION 1..1273: note = SARS-CoV-2/USA/WI-13/2020__EPI_ISL_417516 spike protein (1-1273)(G889C_L1034C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 872 - protein, 1272 aa, synthetic construct
  REGION 1..1272: note = SARS-CoV-2/India/1-27/2020__EPI_ISL_413522 spike protein (1-1272)(G888C_L1033C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 873 - protein, 1267 aa, synthetic construct
  REGION 1..1267: note = SARS-CoV-2/pangolin/Guangxi/P4L/2017__EPI_ISL_410538 spike protein (1-1267)(G883C_L1028C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 874 - protein, 1267 aa, synthetic construct
  REGION 1..1267: note = SARS-CoV-2/pangolin/Guangxi/P5L/2017__EPI_ISL_410540 spike protein (1-1267)(G883C_L1028C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 875 - protein, 1267 aa, synthetic construct
  REGION 1..1267: note = SARS-CoV-2/pangolin/Guangxi/P5E/2017__EPI_ISL_410541 spike protein (1-1267)(G883C_L1028C)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 876 - protein, 1265 aa, synthetic construct
  REGION 1..1265: note = SARS-CoV-2/pangolin/Guangxi/P1E/2017__EPI_ISL_410539 spike protein (1-1265)(G881C_L1026C)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFCAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVCGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 877 - protein, 1273 aa, synthetic construct; identical to SEQ ID NO: 23
  REGION 1..1273: note = SARS-CoV-2/Wuhan/WIV05/2019__EPI_ISL_402128 spike protein (1-1273)(I909C_Y1047C)

SEQ ID NO: 878 - protein, 1269 aa, synthetic construct
  REGION 1..1269: note = SARS-CoV-2/bat/Yunnan/RaTG13/2013__EPI_ISL_402131 spike protein (1-1269)(I905C_Y1043C)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 879 - protein, 1273 aa, synthetic construct
  REGION 1..1273: note = SARS-CoV-2/Wuhan/HBCDC-HB-01/2019__EPI_ISL_402132 spike protein (1-1273)(I909C_Y1047C)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 880 - protein, 1273 aa, synthetic construct
  REGION 1..1273: note = SARS-CoV-2/Guangdong/20SF028/2020__EPI_ISL_403936 spike protein (1-1273)(I909C_Y1047C)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 881 - protein, 1273 aa, synthetic construct
  REGION 1..1273: note = SARS-CoV-2/Shenzhen/SZTH-001/2020__EPI_ISL_406592 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 882 - protein, 1273 aa, synthetic construct
  REGION 1..1273: note = SARS-CoV-2/Shenzhen/SZTH-004/2020__EPI_ISL_406595 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 883 - protein, 1273 aa, synthetic construct
  REGION 1..1273: note = SARS-CoV-2/France/IDF0372/2020__EPI_ISL_406596 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 884 - protein, 1273 aa, synthetic construct
  REGION 1..1273: note = SARS-CoV-2/Australia/VIC01/2020__EPI_ISL_406844 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 885 - protein, 1273 aa, synthetic construct
  REGION 1..1273: note = SARS-CoV-2/Germany/BavPat1/2020__EPI_ISL_406862 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 886 - protein, 1273 aa, synthetic construct
  REGION 1..1273: note = SARS-CoV-2/Wuhan/HBCDC-HB-02/2020__EPI_ISL_412978 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 887 - protein, 1273 aa, synthetic construct
  REGION 1..1273: note = SARS-CoV-2/Australia/QLD02/2020__EPI_ISL_407896 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 888 - protein, 1273 aa, synthetic construct
  REGION 1..1273: note = SARS-CoV-2/India/1-31/2020__EPI_ISL_413523 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 889 - protein, 1273 aa, synthetic construct
  REGION 1..1273: note SARS-CoV-2/Guangdong/GD2020087-P0008/2020__EPI_ISL_413863 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 890 - protein, 1273 aa, synthetic construct
  REGION 1..1273: note = SARS-CoV-2/Sweden/01/2020__EPI_ISL_411951 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 891 - protein, 1273 aa, synthetic construct
  REGION 1..1273: note = SARS-CoV-2/Tianmen/HBCDC-HB-07/2020__EPI_ISL_412983 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 892 - protein, 1273 aa, synthetic construct
  REGION 1..1273: note = SARS-CoV-2/Hong Kong/case42_VM20002493/2020__EPI_ISL_414527 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 893 - protein, 1273 aa, synthetic construct
  REGION 1..1273: note = SARS-CoV-2/USA/CruiseA-23/2020__EPI_ISL_414482 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 894 - protein, 1273 aa, synthetic construct
  REGION 1..1273: note = SARS-CoV-2/Hong Kong/case85_VM20002868/2020__EPI_ISL_414519 spike protein (1-1273)(I909C_Y1047C)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 895 - protein, 1273 aa, synthetic construct
  REGION 1..1273: note = SARS-CoV-2/England/200990660/2020__EPI_ISL_414523 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 896 - protein, 1273 aa, synthetic construct
  REGION 1..1273: note = SARS-CoV-2/Australia/NSW09/2020__EPI_ISL_413595 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 897 - protein, 1273 aa, synthetic construct
  REGION 1..1273: note = SARS-CoV-2/Australia/NSW10/2020__EPI_ISL_413596 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 898 - protein, 1273 aa, synthetic construct
  REGION 1..1273: note SARS-CoV-2/Switzerland/1000477797/2020__EPI_ISL_413023 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 899 - protein, 1273 aa, synthetic construct
  REGION 1..1273: note = SARS-CoV-2/Belgium/BA-02291/2020__EPI_ISL_415159 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 900 - protein, 1273 aa, synthetic construct
  REGION 1..1273: note = SARS-CoV-2/USA/WA8-UW5/2020__EPI_ISL_413486 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 901 - protein, 1273 aa, synthetic construct
  REGION 1..1273: note = SARS-CoV-2/England/20102000506/2020__EPI_ISL_415147 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 902 - protein, 1273 aa, synthetic construct
  REGION 1..1273: note = SARS-CoV-2/Belgium/VAG-03013/2020__EPI_ISL_415155 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 903 - protein, 1273 aa, synthetic construct
  REGION 1..1273: note = SARS-CoV-2/Belgium/BC-03016/2020__EPI_ISL_415157 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 904 - protein, 1273 aa, synthetic construct
  REGION 1..1273: note = SARS-CoV-2/Germany/BavPat3/2020__EPI_ISL_414521 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 905 - protein, 1273 aa, synthetic construct
  REGION 1..1273: note = SARS-CoV-2/France/HF1805/2020__EPI_ISL_414628 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 906 - protein, 1273 aa, synthetic construct
  REGION 1..1273: note SARS-CoV-2/Netherlands/ZuidHolland_9/2020__EPI_ISL_414445 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 907 - protein, 1273 aa, synthetic construct
  REGION 1..1273: note = SARS-CoV-2/Finland/FIN03032020A/2020__EPI_ISL_413602 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 908 - protein, 1273 aa, synthetic construct
  REGION 1..1273: note = SARS-CoV-2/France/GE1977/2020__EPI_ISL_414632 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 909 - protein, 1273 aa, synthetic construct
  REGION 1..1273: note = SARS-CoV-2/Finland/FIN-313/2020__EPI_ISL_414641 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 910 - protein, 1273 aa, synthetic construct
  REGION 1..1273: note SARS-CoV-2/Netherlands/ZuidHolland_2/2020__EPI_ISL_414556 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 911 - protein, 1273 aa, synthetic construct
  REGION 1..1273: note = SARS-CoV-2/USA/WA-UW31/2020__EPI_ISL_414618 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 912 - protein, 1273 aa, synthetic construct
  REGION 1..1273: note = SARS-CoV-2/South Korea/SNU01/2020__EPI_ISL_411929 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 913 - protein, 1273 aa, synthetic construct
  REGION 1..1273: note = SARS-CoV-2/China/WF0004/2020__EPI_ISL_413694 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 914 - protein, 1273 aa, synthetic construct
  REGION 1..1273: note = SARS-CoV-2/China/WF0028/2020__EPI_ISL_413791 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 915 - protein, 1273 aa, synthetic construct
  REGION 1..1273: note = SARS-CoV-2/2019-nCoV/USA-CruiseA-18/2020__MT159716.1 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 916 - protein, 1273 aa, synthetic construct
  REGION 1..1273: note SARS-CoV-2/SARS-CoV-2/Yunnan-01/human/2020/CHN__MT049951.1 spike protein (1-1273)(I909C_Y1047C)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 917 - protein, 1273 aa, synthetic construct
  REGION 1..1273: note = SARS-CoV-2/USA/WA-UW292/2020__EPI_ISL_418077 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 918 - protein, 1273 aa, synthetic construct
  REGION 1..1273: note = SARS-CoV-2/Iceland/192/2020__EPI_ISL_417819 spike protein (1-1273)(I909C_Y1047C)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 919 - protein, 1273 aa, synthetic construct
  REGION 1..1273: note = SARS-CoV-2/Belgium/ULG-6939/2020__EPI_ISL_417020 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 920 - protein, 1273 aa, synthetic construct
  REGION 1..1273: note = SARS-CoV-2/France/HF2496/2020__EPI_ISL_418231 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 921 - protein, 1273 aa, synthetic construct
  REGION 1..1273: note = SARS-CoV-2/USA/WA-UW291/2020__EPI_ISL_418076 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 922 - protein, 1273 aa, synthetic construct
  REGION 1..1273: note = SARS-CoV-2/Portugal/PT0034/2020__EPI_ISL_418019 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 923 - protein, 1273 aa, synthetic construct
  REGION 1..1273: note = SARS-CoV-2/Iceland/202/2020__EPI_ISL_417750 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 924 - protein, 1273 aa, synthetic construct
  REGION 1..1273: note = SARS-CoV-2/USA/WA-UW261/2020__EPI_ISL_418046 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 925 - protein, 1273 aa, synthetic construct
  REGION 1..1273: note = SARS-CoV-2/Portugal/PT0035/2020__EPI_ISL_418020 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 926 - protein, 1273 aa, synthetic construct
  REGION 1..1273: note = SARS-CoV-2/USA/NY-NYUMC7/2020__EPI_ISL_418192 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 927 - protein, 1273 aa, synthetic construct
  REGION 1..1273: note = SARS-CoV-2/Iceland/189/2020__EPI_ISL_417709 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 928 - protein, 1273 aa, synthetic construct
  REGION 1..1273: note = SARS-CoV-2/Australia/NSW56/2020__EPI_ISL_417408 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 929 - protein, 1273 aa, synthetic construct
  REGION 1..1273: note = SARS-CoV-2/Iceland/280/2020__EPI_ISL_417608 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 930 - protein, 1273 aa, synthetic construct
  REGION 1..1273: note = SARS-CoV-2/Iceland/247/2020__EPI_ISL_417575 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 931 - protein, 1273 aa, synthetic construct
  REGION 1..1273: note = SARS-CoV-2/Iceland/238/2020__EPI_ISL_417566 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 932 - protein, 1273 aa, synthetic construct
  REGION 1..1273: note = SARS-CoV-2/Greece/16/2020__EPI_ISL_418265 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 933 - protein, 1273 aa, synthetic construct
  REGION 1..1273: note = SARS-CoV-2/Iceland/319/2020__EPI_ISL_417648 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 934 - protein, 1273 aa, synthetic construct
  REGION 1..1273: note = SARS-CoV-2/Congo/94/2020__EPI_ISL_417947 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 935 - protein, 1273 aa, synthetic construct
  REGION 1..1273: note = SARS-CoV-2/Congo/158/2020__EPI_ISL_417950 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 936 - protein, 1273 aa, synthetic construct
  REGION 1..1273: note = SARS-CoV-2/USA/UT-00034/2020__EPI_ISL_417977 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 937 - protein, 1273 aa, synthetic construct
  REGION 1..1273: note = SARS-CoV-2/USA/UT-00033/2020__EPI_ISL_417976 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 938 - protein, 1273 aa, synthetic construct
  REGION 1..1273: note = SARS-CoV-2/USA/WI-13/2020__EPI_ISL_417516 spike protein (1-1273)(I909C_Y1047C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 939 - protein, 1272 aa, synthetic construct
  REGION 1..1272: note = SARS-CoV-2/India/1-27/2020__EPI_ISL_413522 spike protein (1-1272)(I908C_Y1046C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 940 - protein, 1267 aa, synthetic construct
  REGION 1..1267: note = SARS-CoV-2/pangolin/Guangxi/P4L/2017__EPI_ISL_410538 spike protein (1-1267)(I903C_Y1041C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 941 - protein, 1267 aa, synthetic construct
  REGION 1..1267: note = SARS-CoV-2/pangolin/Guangxi/P5L/2017__EPI_ISL_410540 spike protein (1-1267)(I903C_Y1041C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 942 - protein, 1267 aa, synthetic construct
  REGION 1..1267: note = SARS-CoV-2/pangolin/Guangxi/P5E/2017__EPI_ISL_410541 spike protein (1-1267)(I903C_Y1041C)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 943 - protein, 1265 aa, synthetic construct
  REGION 1..1265: note = SARS-CoV-2/pangolin/Guangxi/P1E/2017__EPI_ISL_410539 spike protein (1-1265)(I901C_Y1039C)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGCGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGCHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 944 - protein, 1273 aa, synthetic construct; identical to SEQ ID NO: 24
  REGION 1..1273: note = SARS-CoV-2/Wuhan/WIV05/2019__EPI_ISL_402128 spike protein (1-1273)(Q965C_S1003C)

SEQ ID NO: 945 - protein, 1269 aa, synthetic construct
  REGION 1..1269: note = SARS-CoV-2/bat/Yunnan/RaTG13/2013__EPI_ISL_402131 spike protein (1-1269)(Q961C_S999C)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 946 - protein, 1273 aa, synthetic construct
  REGION 1..1273: note = SARS-CoV-2/Wuhan/HBCDC-HB-01/2019__EPI_ISL_402132 spike protein (1-1273)(Q965C_S1003C)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 947 - protein, 1273 aa, synthetic construct
  REGION 1..1273: note = SARS-CoV-2/Guangdong/20SF028/2020__EPI_ISL_403936 spike protein (1-1273)(Q965C_S1003C)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 948 - protein, 1273 aa, synthetic construct
  REGION 1..1273: note = SARS-CoV-2/Shenzhen/SZTH-001/2020__EPI_ISL_406592 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 949 - protein, 1273 aa, synthetic construct
  REGION 1..1273: note = SARS-CoV-2/Shenzhen/SZTH-004/2020__EPI_ISL_406595 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 950 - protein, 1273 aa, synthetic construct
  REGION 1..1273: note = SARS-CoV-2/France/IDF0372/2020__EPI_ISL_406596 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 951 - protein, 1273 aa, synthetic construct
  REGION 1..1273: note = SARS-CoV-2/Australia/VIC01/2020__EPI_ISL_406844 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 952 - protein, 1273 aa, synthetic construct
  REGION 1..1273: note = SARS-CoV-2/Germany/BavPat1/2020__EPI_ISL_406862 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 953 - protein, 1273 aa, synthetic construct
  REGION 1..1273: note = SARS-CoV-2/Wuhan/HBCDC-HB-02/2020__EPI_ISL_412978 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 954 - protein, 1273 aa, synthetic construct
  REGION 1..1273: note = SARS-CoV-2/Australia/QLD02/2020__EPI_ISL_407896 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 955 - protein, 1273 aa, synthetic construct
  REGION 1..1273: note = SARS-CoV-2/India/1-31/2020__EPI_ISL_413523 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSVIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 956 - protein, 1273 aa, synthetic construct
  REGION 1..1273: note SARS-CoV-2/Guangdong/GD2020087-P0008/2020__EPI_ISL_413863 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 957 - protein, 1273 aa, synthetic construct
  REGION 1..1273: note = SARS-CoV-2/Sweden/01/2020__EPI_ISL_411951 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 958 - protein, 1273 aa, synthetic construct
  REGION 1..1273: note = SARS-CoV-2/Tianmen/HBCDC-HB-07/2020__EPI_ISL_412983 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 959 - protein, 1273 aa, synthetic construct
  REGION 1..1273: note = SARS-CoV-2/Hong Kong/case42_VM20002493/2020__EPI_ISL_414527 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 960 - protein, 1273 aa, synthetic construct
  REGION 1..1273: note = SARS-CoV-2/USA/CruiseA-23/2020__EPI_ISL_414482 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 961 - protein, 1273 aa, synthetic construct
  REGION 1..1273: note = SARS-CoV-2/Hong Kong/case85_VM20002868/2020__EPI_ISL_414519 spike protein (1-1273)(Q965C_S1003C)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 962 - protein, 1273 aa, synthetic construct
  REGION 1..1273: note = SARS-CoV-2/England/200990660/2020__EPI_ISL_414523 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 963 - protein, 1273 aa, synthetic construct
  REGION 1..1273: note = SARS-CoV-2/Australia/NSW09/2020__EPI_ISL_413595 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSFTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 964 - protein, 1273 aa, synthetic construct
  REGION 1..1273: note = SARS-CoV-2/Australia/NSW10/2020__EPI_ISL_413596 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 965 - protein, 1273 aa, synthetic construct
  REGION 1..1273: note SARS-CoV-2/Switzerland/1000477797/2020__EPI_ISL_413023 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 966 - protein, 1273 aa, synthetic construct
  REGION 1..1273: note = SARS-CoV-2/Belgium/BA-02291/2020__EPI_ISL_415159 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSAAPALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 967 - protein, 1273 aa, synthetic construct
  REGION 1..1273: note = SARS-CoV-2/USA/WA8-UW5/2020__EPI_ISL_413486 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 968 - protein, 1273 aa, synthetic construct
  REGION 1..1273: note = SARS-CoV-2/England/20102000506/2020__EPI_ISL_415147 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 969 - protein, 1273 aa, synthetic construct
  REGION 1..1273: note = SARS-CoV-2/Belgium/VAG-03013/2020__EPI_ISL_415155 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTATALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 970 - protein, 1273 aa, synthetic construct
  REGION 1..1273: note = SARS-CoV-2/Belgium/BC-03016/2020__EPI_ISL_415157 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTAPALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 971 - protein, 1273 aa, synthetic construct
  REGION 1..1273: note = SARS-CoV-2/Germany/BavPat3/2020__EPI_ISL_414521 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 972 - protein, 1273 aa, synthetic construct
  REGION 1..1273: note = SARS-CoV-2/France/HF1805/2020__EPI_ISL_414628 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 973 - protein, 1273 aa, synthetic construct
  REGION 1..1273: note SARS-CoV-2/Netherlands/ZuidHolland_9/2020__EPI_ISL_414445 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 974 - protein, 1273 aa, synthetic construct
  REGION 1..1273: note = SARS-CoV-2/Finland/FIN03032020A/2020__EPI_ISL_413602 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 975 - protein, 1273 aa, synthetic construct
  REGION 1..1273: note = SARS-CoV-2/France/GE1977/2020__EPI_ISL_414632 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLFSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 976 - protein, 1273 aa, synthetic construct
  REGION 1..1273: note = SARS-CoV-2/Finland/FIN-313/2020__EPI_ISL_414641 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 977 - protein, 1273 aa, synthetic construct
  REGION 1..1273: note SARS-CoV-2/Netherlands/ZuidHolland_2/2020__EPI_ISL_414556 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 978 - protein, 1273 aa, synthetic construct
  REGION 1..1273: note = SARS-CoV-2/USA/WA-UW31/2020__EPI_ISL_414618 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 979 - protein, 1273 aa, synthetic construct
  REGION 1..1273: note = SARS-CoV-2/South Korea/SNU01/2020__EPI_ISL_411929 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 980 - protein, 1273 aa, synthetic construct
  REGION 1..1273: note = SARS-CoV-2/China/WF0004/2020__EPI_ISL_413694 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 981 - protein, 1273 aa, synthetic construct
  REGION 1..1273: note = SARS-CoV-2/China/WF0028/2020__EPI_ISL_413791 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 982 - protein, 1273 aa, synthetic construct
  REGION 1..1273: note = SARS-CoV-2/2019-nCoV/USA-CruiseA-18/2020__MT159716.1 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 983 - protein, 1273 aa, synthetic construct
  REGION 1..1273: note SARS-CoV-2/SARS-CoV-2/Yunnan-01/human/2020/CHN__MT049951.1 spike protein (1-1273)(Q965C_S1003C)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 984 - protein, 1273 aa, synthetic construct
  REGION 1..1273: note = SARS-CoV-2/USA/WA-UW292/2020__EPI_ISL_418077 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 985 - protein, 1273 aa, synthetic construct
  REGION 1..1273: note = SARS-CoV-2/Iceland/192/2020__EPI_ISL_417819 spike protein (1-1273)(Q965C_S1003C)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 986 - protein, 1273 aa, synthetic construct
  REGION 1..1273: note = SARS-CoV-2/Belgium/ULG-6939/2020__EPI_ISL_417020 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 987 - protein, 1273 aa, synthetic construct
  REGION 1..1273: note = SARS-CoV-2/France/HF2496/2020__EPI_ISL_418231 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 988 - protein, 1273 aa, synthetic construct
  REGION 1..1273: note = SARS-CoV-2/USA/WA-UW291/2020__EPI_ISL_418076 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQYSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 989 - protein, 1273 aa, synthetic construct
  REGION 1..1273: note = SARS-CoV-2/Portugal/PT0034/2020__EPI_ISL_418019 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 990 - protein, 1273 aa, synthetic construct
  REGION 1..1273: note = SARS-CoV-2/Iceland/202/2020__EPI_ISL_417750 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 991 - protein, 1273 aa, synthetic construct
  REGION 1..1273: note = SARS-CoV-2/USA/WA-UW261/2020__EPI_ISL_418046 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 992 - protein, 1273 aa, synthetic construct
  REGION 1..1273: note = SARS-CoV-2/Portugal/PT0035/2020__EPI_ISL_418020 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 993 - protein, 1273 aa, synthetic construct
  REGION 1..1273: note = SARS-CoV-2/USA/NY-NYUMC7/2020__EPI_ISL_418192 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 994 - protein, 1273 aa, synthetic construct
  REGION 1..1273: note = SARS-CoV-2/Iceland/189/2020__EPI_ISL_417709 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 995 - protein, 1273 aa, synthetic construct
  REGION 1..1273: note = SARS-CoV-2/Australia/NSW56/2020__EPI_ISL_417408 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 996 - protein, 1273 aa, synthetic construct
  REGION 1..1273: note = SARS-CoV-2/Iceland/280/2020__EPI_ISL_417608 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 997 - protein, 1273 aa, synthetic construct
  REGION 1..1273: note = SARS-CoV-2/Iceland/247/2020__EPI_ISL_417575 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 998 - protein, 1273 aa, synthetic construct
  REGION 1..1273: note = SARS-CoV-2/Iceland/238/2020__EPI_ISL_417566 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 999 - protein, 1273 aa, synthetic construct
  REGION 1..1273: note = SARS-CoV-2/Greece/16/2020__EPI_ISL_418265 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1000 - protein, 1273 aa, synthetic construct
  REGION 1..1273: note = SARS-CoV-2/Iceland/319/2020__EPI_ISL_417648 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1001 - protein, 1273 aa, synthetic construct
  REGION 1..1273: note = SARS-CoV-2/Congo/94/2020__EPI_ISL_417947 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1002 - protein, 1273 aa, synthetic construct
  REGION 1..1273: note = SARS-CoV-2/Congo/158/2020__EPI_ISL_417950 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1003 - protein, 1273 aa, synthetic construct
  REGION 1..1273: note = SARS-CoV-2/USA/UT-00034/2020__EPI_ISL_417977 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1004 - protein, 1273 aa, synthetic construct
  REGION 1..1273: note = SARS-CoV-2/USA/UT-00033/2020__EPI_ISL_417976 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1005 - protein, 1273 aa, synthetic construct
  REGION 1..1273: note = SARS-CoV-2/USA/WI-13/2020__EPI_ISL_417516 spike protein (1-1273)(Q965C_S1003C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1006 - protein, 1272 aa, synthetic construct
  REGION 1..1272: note = SARS-CoV-2/India/1-27/2020__EPI_ISL_413522 spike protein (1-1272)(Q964C_S1002C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1007 - protein, 1267 aa, synthetic construct
  REGION 1..1267: note = SARS-CoV-2/pangolin/Guangxi/P4L/2017__EPI_ISL_410538 spike protein (1-1267)(Q959C_S997C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 1008 - protein, 1267 aa, synthetic construct
  REGION 1..1267: note = SARS-CoV-2/pangolin/Guangxi/P5L/2017__EPI_ISL_410540 spike protein (1-1267)(Q959C_S997C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 1009 - protein, 1267 aa, synthetic construct
  REGION 1..1267: note = SARS-CoV-2/pangolin/Guangxi/P5E/2017__EPI_ISL_410541 spike protein (1-1267)(Q959C_S997C)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 1010 - protein, 1265 aa, synthetic construct
  REGION 1..1265: note = SARS-CoV-2/pangolin/Guangxi/P1E/2017__EPI_ISL_410539 spike protein (1-1265)(Q957C_S995C)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKCLSSNFGAISSVLNDILSRLDKVEAEVQIDRLITGRLQCLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 1011 - protein, 1273 aa, synthetic construct; identical to SEQ ID NO: 25
  REGION 1..1273: note = SARS-CoV-2/Wuhan/WIV05/2019__EPI_ISL_402128 spike protein (1-1273)(F970C_G999C)

SEQ ID NO: 1012 - protein, 1269 aa, synthetic construct
  REGION 1..1269: note = SARS-CoV-2/bat/Yunnan/RaTG13/2013__EPI_ISL_402131 spike protein (1-1269)(F966C_G995C)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 1013 - protein, 1273 aa, synthetic construct
  REGION 1..1273: note = SARS-CoV-2/Wuhan/HBCDC-HB-01/2019__EPI_ISL_402132 spike protein (1-1273)(F970C_G999C)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1014 - protein, 1273 aa, synthetic construct
  REGION 1..1273: note = SARS-CoV-2/Guangdong/20SF028/2020__EPI_ISL_403936 spike protein (1-1273)(F970C_G999C)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1015 - protein, 1273 aa, synthetic construct
  REGION 1..1273: note = SARS-CoV-2/Shenzhen/SZTH-001/2020__EPI_ISL_406592 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 1016 - protein, 1273 aa, synthetic construct
  REGION 1..1273: note = SARS-CoV-2/Shenzhen/SZTH-004/2020__EPI_ISL_406595 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1017 - protein, 1273 aa, synthetic construct
  REGION 1..1273: note = SARS-CoV-2/France/IDF0372/2020__EPI_ISL_406596 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1018 - protein, 1273 aa, synthetic construct
  REGION 1..1273: note = SARS-CoV-2/Australia/VIC01/2020__EPI_ISL_406844 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1019 - protein, 1273 aa, synthetic construct
  REGION 1..1273: note = SARS-CoV-2/Germany/BavPat1/2020__EPI_ISL_406862 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1020 - protein, 1273 aa, synthetic construct
  REGION 1..1273: note = SARS-CoV-2/Wuhan/HBCDC-HB-02/2020__EPI_ISL_412978 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1021 - protein, 1273 aa, synthetic construct
  REGION 1..1273: note = SARS-CoV-2/Australia/QLD02/2020__EPI_ISL_407896 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1022 - protein, 1273 aa, synthetic construct
  REGION 1..1273: note = SARS-CoV-2/India/1-31/2020__EPI_ISL_413523 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSVIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1023 - protein, 1273 aa, synthetic construct
  REGION 1..1273: note SARS-CoV-2/Guangdong/GD2020087-P0008/2020__EPI_ISL_413863 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1024 - protein, 1273 aa, synthetic construct
  REGION 1..1273: note = SARS-CoV-2/Sweden/01/2020__EPI_ISL_411951 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1025 - protein, 1273 aa, synthetic construct
  REGION 1..1273: note = SARS-CoV-2/Tianmen/HBCDC-HB-07/2020__EPI_ISL_412983 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1026 - protein, 1273 aa, synthetic construct
  REGION 1..1273: note = SARS-CoV-2/Hong Kong/case42_VM20002493/2020__EPI_ISL_414527 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1027 - protein, 1273 aa, synthetic construct
  REGION 1..1273: note = SARS-CoV-2/USA/CruiseA-23/2020__EPI_ISL_414482 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1028 - protein, 1273 aa, synthetic construct
  REGION 1..1273: note = SARS-CoV-2/Hong Kong/case85_VM20002868/2020__EPI_ISL_414519 spike protein (1-1273)(F970C_G999C)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1029 - protein, 1273 aa, synthetic construct
  REGION 1..1273: note = SARS-CoV-2/England/200990660/2020__EPI_ISL_414523 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 1030 - protein, 1273 aa, synthetic construct
  REGION 1..1273: note = SARS-CoV-2/Australia/NSW09/2020__EPI_ISL_413595 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSFTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1031 - protein, 1273 aa, synthetic construct
  REGION 1..1273: note = SARS-CoV-2/Australia/NSW10/2020__EPI_ISL_413596 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 1032 - protein, 1273 aa, synthetic construct
  REGION 1..1273: note SARS-CoV-2/Switzerland/1000477797/2020__EPI_ISL_413023 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1033 - protein, 1273 aa, synthetic construct
  REGION 1..1273: note = SARS-CoV-2/Belgium/BA-02291/2020__EPI_ISL_415159 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSAAPALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1034 - protein, 1273 aa, synthetic construct
  REGION 1..1273: note = SARS-CoV-2/USA/WA8-UW5/2020__EPI_ISL_413486 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1035 - protein, 1273 aa, synthetic construct
  REGION 1..1273: note = SARS-CoV-2/England/20102000506/2020__EPI_ISL_415147 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1036 - protein, 1273 aa, synthetic construct
  REGION 1..1273: note = SARS-CoV-2/Belgium/VAG-03013/2020__EPI_ISL_415155 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTATALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1037 - protein, 1273 aa, synthetic construct
  REGION 1..1273: note = SARS-CoV-2/Belgium/BC-03016/2020__EPI_ISL_415157 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTAPALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1038 - protein, 1273 aa, synthetic construct
  REGION 1..1273: note = SARS-CoV-2/Germany/BavPat3/2020__EPI_ISL_414521 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1039 - protein, 1273 aa, synthetic construct
  REGION 1..1273: note = SARS-CoV-2/France/HF1805/2020__EPI_ISL_414628 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1040 - protein, 1273 aa, synthetic construct
  REGION 1..1273: note SARS-CoV-2/Netherlands/ZuidHolland_9/2020__EPI_ISL_414445 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1041 - protein, 1273 aa, synthetic construct
  REGION 1..1273: note = SARS-CoV-2/Finland/FIN03032020A/2020__EPI_ISL_413602 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1042 - protein, 1273 aa, synthetic construct
  REGION 1..1273: note = SARS-CoV-2/France/GE1977/2020__EPI_ISL_414632 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLFSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1043 - protein, 1273 aa, synthetic construct
  REGION 1..1273: note = SARS-CoV-2/Finland/FIN-313/2020__EPI_ISL_414641 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1044 - protein, 1273 aa, synthetic construct
  REGION 1..1273: note SARS-CoV-2/Netherlands/ZuidHolland_2/2020__EPI_ISL_414556 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1045 - protein, 1273 aa, synthetic construct
  REGION 1..1273: note = SARS-CoV-2/USA/WA-UW31/2020__EPI_ISL_414618 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1046 - protein, 1273 aa, synthetic construct
  REGION 1..1273: note = SARS-CoV-2/South Korea/SNU01/2020__EPI_ISL_411929 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1047 - protein, 1273 aa, synthetic construct
  REGION 1..1273: note = SARS-CoV-2/China/WF0004/2020__EPI_ISL_413694 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1048 - protein, 1273 aa, synthetic construct
  REGION 1..1273: note = SARS-CoV-2/China/WF0028/2020__EPI_ISL_413791 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1049 - protein, 1273 aa, synthetic construct
  REGION 1..1273: note = SARS-CoV-2/2019-nCoV/USA-CruiseA-18/2020__MT159716.1 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1050 - protein, 1273 aa, synthetic construct
  REGION 1..1273: note SARS-CoV-2/SARS-CoV-2/Yunnan-01/human/2020/CHN__MT049951.1 spike protein (1-1273)(F970C_G999C)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1051 - protein, 1273 aa, synthetic construct
  REGION 1..1273: note = SARS-CoV-2/USA/WA-UW292/2020__EPI_ISL_418077 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1052 - protein, 1273 aa, synthetic construct
  REGION 1..1273: note = SARS-CoV-2/Iceland/192/2020__EPI_ISL_417819 spike protein (1-1273)(F970C_G999C)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1053 - protein, 1273 aa, synthetic construct
  REGION 1..1273: note = SARS-CoV-2/Belgium/ULG-6939/2020__EPI_ISL_417020 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1054 - protein, 1273 aa, synthetic construct
  REGION 1..1273: note = SARS-CoV-2/France/HF2496/2020__EPI_ISL_418231 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1055 - protein, 1273 aa, synthetic construct
  REGION 1..1273: note = SARS-CoV-2/USA/WA-UW291/2020__EPI_ISL_418076 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQYSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1056 - protein, 1273 aa, synthetic construct
  REGION 1..1273: note = SARS-CoV-2/Portugal/PT0034/2020__EPI_ISL_418019 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 1057 - protein, 1273 aa, synthetic construct
  REGION 1..1273: note = SARS-CoV-2/Iceland/202/2020__EPI_ISL_417750 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1058 - protein, 1273 aa, synthetic construct
  REGION 1..1273: note = SARS-CoV-2/USA/WA-UW261/2020__EPI_ISL_418046 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1059 - protein, 1273 aa, synthetic construct
  REGION 1..1273: note = SARS-CoV-2/Portugal/PT0035/2020__EPI_ISL_418020 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1060 - protein, 1273 aa, synthetic construct
  REGION 1..1273: note = SARS-CoV-2/USA/NY-NYUMC7/2020__EPI_ISL_418192 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1061 - protein, 1273 aa, synthetic construct
  REGION 1..1273: note = SARS-CoV-2/Iceland/189/2020__EPI_ISL_417709 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1062 - protein, 1273 aa, synthetic construct
  REGION 1..1273: note = SARS-CoV-2/Australia/NSW56/2020__EPI_ISL_417408 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1063 - protein, 1273 aa, synthetic construct
  REGION 1..1273: note = SARS-CoV-2/Iceland/280/2020__EPI_ISL_417608 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1064 - protein, 1273 aa, synthetic construct
  REGION 1..1273: note = SARS-CoV-2/Iceland/247/2020__EPI_ISL_417575 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 1065 - protein, 1273 aa, synthetic construct
  REGION 1..1273: note = SARS-CoV-2/Iceland/238/2020__EPI_ISL_417566 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1066 - protein, 1273 aa, synthetic construct
  REGION 1..1273: note = SARS-CoV-2/Greece/16/2020__EPI_ISL_418265 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1067 - protein, 1273 aa, synthetic construct
  REGION 1..1273: note = SARS-CoV-2/Iceland/319/2020__EPI_ISL_417648 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1068 - protein, 1273 aa, synthetic construct
  REGION 1..1273: note = SARS-CoV-2/Congo/94/2020__EPI_ISL_417947 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1069 - protein, 1273 aa, synthetic construct
  REGION 1..1273: note = SARS-CoV-2/Congo/158/2020__EPI_ISL_417950 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1070 - protein, 1273 aa, synthetic construct
  REGION 1..1273: note = SARS-CoV-2/USA/UT-00034/2020__EPI_ISL_417977 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1071 - protein, 1273 aa, synthetic construct
  REGION 1..1273: note = SARS-CoV-2/USA/UT-00033/2020__EPI_ISL_417976 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1072 - protein, 1273 aa, synthetic construct
  REGION 1..1273: note = SARS-CoV-2/USA/WI-13/2020__EPI_ISL_417516 spike protein (1-1273)(F970C_G999C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1073 - protein, 1272 aa, synthetic construct
  REGION 1..1272: note = SARS-CoV-2/India/1-27/2020__EPI_ISL_413522 spike protein (1-1272)(F969C_G998C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1074 - protein, 1267 aa, synthetic construct
  REGION 1..1267: note = SARS-CoV-2/pangolin/Guangxi/P4L/2017__EPI_ISL_410538 spike protein (1-1267)(F964C_G993C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 1075 - protein, 1267 aa, synthetic construct
  REGION 1..1267: note = SARS-CoV-2/pangolin/Guangxi/P5L/2017__EPI_ISL_410540 spike protein (1-1267)(F964C_G993C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 1076 - protein, 1267 aa, synthetic construct
  REGION 1..1267: note = SARS-CoV-2/pangolin/Guangxi/P5E/2017__EPI_ISL_410541 spike protein (1-1267)(F964C_G993C)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 1077 - protein, 1265 aa, synthetic construct
  REGION 1..1265: note = SARS-CoV-2/pangolin/Guangxi/P1E/2017__EPI_ISL_410539 spike protein (1-1265)(F962C_G991C)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNCGAISSVLNDILSRLDKVEAEVQIDRLITCRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 1078 - protein, 1273 aa, synthetic construct; identical to SEQ ID NO: 26
  REGION 1..1273: note = SARS-CoV-2/Wuhan/WIV05/2019__EPI_ISL_402128 spike protein (1-1273)(A972C_R995C)

SEQ ID NO: 1079 - protein, 1269 aa, synthetic construct
  REGION 1..1269: note = SARS-CoV-2/bat/Yunnan/RaTG13/2013__EPI_ISL_402131 spike protein (1-1269)(A968C_R991C)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 1080 - protein, 1273 aa, synthetic construct
  REGION 1..1273: note = SARS-CoV-2/Wuhan/HBCDC-HB-01/2019__EPI_ISL_402132 spike protein (1-1273)(A972C_R995C)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1081 - protein, 1273 aa, synthetic construct
  REGION 1..1273: note = SARS-CoV-2/Guangdong/20SF028/2020__EPI_ISL_403936 spike protein (1-1273)(A972C_R995C)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1082 - protein, 1273 aa, synthetic construct
  REGION 1..1273: note = SARS-CoV-2/Shenzhen/SZTH-001/2020__EPI_ISL_406592 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 1083 - protein, 1273 aa, synthetic construct
  REGION 1..1273: note = SARS-CoV-2/Shenzhen/SZTH-004/2020__EPI_ISL_406595 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1084 - protein, 1273 aa, synthetic construct
  REGION 1..1273: note = SARS-CoV-2/France/IDF0372/2020__EPI_ISL_406596 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1085 - protein, 1273 aa, synthetic construct
  REGION 1..1273: note = SARS-CoV-2/Australia/VIC01/2020__EPI_ISL_406844 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1086 - protein, 1273 aa, synthetic construct
  REGION 1..1273: note = SARS-CoV-2/Germany/BavPat1/2020__EPI_ISL_406862 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1087 - protein, 1273 aa, synthetic construct
  REGION 1..1273: note = SARS-CoV-2/Wuhan/HBCDC-HB-02/2020__EPI_ISL_412978 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1088 - protein, 1273 aa, synthetic construct
  REGION 1..1273: note = SARS-CoV-2/Australia/QLD02/2020__EPI_ISL_407896 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1089 - protein, 1273 aa, synthetic construct
  REGION 1..1273: note = SARS-CoV-2/India/1-31/2020__EPI_ISL_413523 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSVIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1090 - protein, 1273 aa, synthetic construct
  REGION 1..1273: note SARS-CoV-2/Guangdong/GD2020087-P0008/2020__EPI_ISL_413863 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1091 - protein, 1273 aa, synthetic construct
  REGION 1..1273: note = SARS-CoV-2/Sweden/01/2020__EPI_ISL_411951 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1092 - protein, 1273 aa, synthetic construct
  REGION 1..1273: note = SARS-CoV-2/Tianmen/HBCDC-HB-07/2020__EPI_ISL_412983 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1093 - protein, 1273 aa, synthetic construct
  REGION 1..1273: note = SARS-CoV-2/Hong Kong/case42_VM20002493/2020__EPI_ISL_414527 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1094 - protein, 1273 aa, synthetic construct
  REGION 1..1273: note = SARS-CoV-2/USA/CruiseA-23/2020__EPI_ISL_414482 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1095 - protein, 1273 aa, synthetic construct
  REGION 1..1273: note = SARS-CoV-2/Hong Kong/case85_VM20002868/2020__EPI_ISL_414519 spike protein (1-1273)(A972C_R995C)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1096 - protein, 1273 aa, synthetic construct
  REGION 1..1273: note = SARS-CoV-2/England/200990660/2020__EPI_ISL_414523 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 1097 - protein, 1273 aa, synthetic construct
  REGION 1..1273: note = SARS-CoV-2/Australia/NSW09/2020__EPI_ISL_413595 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSFTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1098 - protein, 1273 aa, synthetic construct
  REGION 1..1273: note = SARS-CoV-2/Australia/NSW10/2020__EPI_ISL_413596 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 1099 - protein, 1273 aa, synthetic construct
  REGION 1..1273: note SARS-CoV-2/Switzerland/1000477797/2020__EPI_ISL_413023 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1100 - protein, 1273 aa, synthetic construct
  REGION 1..1273: note = SARS-CoV-2/Belgium/BA-02291/2020__EPI_ISL_415159 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSAAPALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1101 - protein, 1273 aa, synthetic construct
  REGION 1..1273: note = SARS-CoV-2/USA/WA8-UW5/2020__EPI_ISL_413486 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1102 - protein, 1273 aa, synthetic construct
  REGION 1..1273: note = SARS-CoV-2/England/20102000506/2020__EPI_ISL_415147 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1103 - protein, 1273 aa, synthetic construct
  REGION 1..1273: note = SARS-CoV-2/Belgium/VAG-03013/2020__EPI_ISL_415155 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTATALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1104 - protein, 1273 aa, synthetic construct
  REGION 1..1273: note = SARS-CoV-2/Belgium/BC-03016/2020__EPI_ISL_415157 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTAPALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1105 - protein, 1273 aa, synthetic construct
  REGION 1..1273: note = SARS-CoV-2/Germany/BavPat3/2020__EPI_ISL_414521 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1106 - protein, 1273 aa, synthetic construct
  REGION 1..1273: note = SARS-CoV-2/France/HF1805/2020__EPI_ISL_414628 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1107 - protein, 1273 aa, synthetic construct
  REGION 1..1273: note SARS-CoV-2/Netherlands/ZuidHolland_9/2020__EPI_ISL_414445 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1108 - protein, 1273 aa, synthetic construct
  REGION 1..1273: note = SARS-CoV-2/Finland/FIN03032020A/2020__EPI_ISL_413602 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1109 - protein, 1273 aa, synthetic construct
  REGION 1..1273: note = SARS-CoV-2/France/GE1977/2020__EPI_ISL_414632 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLFSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1110 - protein, 1273 aa, synthetic construct
  REGION 1..1273: note = SARS-CoV-2/Finland/FIN-313/2020__EPI_ISL_414641 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1111 - protein, 1273 aa, synthetic construct
  REGION 1..1273: note SARS-CoV-2/Netherlands/ZuidHolland_2/2020__EPI_ISL_414556 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1112 - protein, 1273 aa, synthetic construct
  REGION 1..1273: note = SARS-CoV-2/USA/WA-UW31/2020__EPI_ISL_414618 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1113 - protein, 1273 aa, synthetic construct
  REGION 1..1273: note = SARS-CoV-2/South Korea/SNU01/2020__EPI_ISL_411929 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1114 - protein, 1273 aa, synthetic construct
  REGION 1..1273: note = SARS-CoV-2/China/WF0004/2020__EPI_ISL_413694 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1115 - protein, 1273 aa, synthetic construct
  REGION 1..1273: note = SARS-CoV-2/China/WF0028/2020__EPI_ISL_413791 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1116 - protein, 1273 aa, synthetic construct
  REGION 1..1273: note = SARS-CoV-2/2019-nCoV/USA-CruiseA-18/2020__MT159716.1 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1117 - protein, 1273 aa, synthetic construct
  REGION 1..1273: note SARS-CoV-2/SARS-CoV-2/Yunnan-01/human/2020/CHN__MT049951.1 spike protein (1-1273)(A972C_R995C)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1118 - protein, 1273 aa, synthetic construct
  REGION 1..1273: note = SARS-CoV-2/USA/WA-UW292/2020__EPI_ISL_418077 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1119 - protein, 1273 aa, synthetic construct
  REGION 1..1273: note = SARS-CoV-2/Iceland/192/2020__EPI_ISL_417819 spike protein (1-1273)(A972C_R995C)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1120 - protein, 1273 aa, synthetic construct
  REGION 1..1273: note = SARS-CoV-2/Belgium/ULG-6939/2020__EPI_ISL_417020 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1121 - protein, 1273 aa, synthetic construct
  REGION 1..1273: note = SARS-CoV-2/France/HF2496/2020__EPI_ISL_418231 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1122 - protein, 1273 aa, synthetic construct
  REGION 1..1273: note = SARS-CoV-2/USA/WA-UW291/2020__EPI_ISL_418076 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQYSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1123 - protein, 1273 aa, synthetic construct
  REGION 1..1273: note = SARS-CoV-2/Portugal/PT0034/2020__EPI_ISL_418019 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 1124 - protein, 1273 aa, synthetic construct
  REGION 1..1273: note = SARS-CoV-2/Iceland/202/2020__EPI_ISL_417750 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1125 - protein, 1273 aa, synthetic construct
  REGION 1..1273: note = SARS-CoV-2/USA/WA-UW261/2020__EPI_ISL_418046 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1126 - protein, 1273 aa, synthetic construct
  REGION 1..1273: note = SARS-CoV-2/Portugal/PT0035/2020__EPI_ISL_418020 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1127 - protein, 1273 aa, synthetic construct
  REGION 1..1273: note = SARS-CoV-2/USA/NY-NYUMC7/2020__EPI_ISL_418192 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1128 - protein, 1273 aa, synthetic construct
  REGION 1..1273: note = SARS-CoV-2/Iceland/189/2020__EPI_ISL_417709 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1129 - protein, 1273 aa, synthetic construct
  REGION 1..1273: note = SARS-CoV-2/Australia/NSW56/2020__EPI_ISL_417408 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1130 - protein, 1273 aa, synthetic construct
  REGION 1..1273: note = SARS-CoV-2/Iceland/280/2020__EPI_ISL_417608 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1131 - protein, 1273 aa, synthetic construct
  REGION 1..1273: note = SARS-CoV-2/Iceland/247/2020__EPI_ISL_417575 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 1132 - protein, 1273 aa, synthetic construct
  REGION 1..1273: note = SARS-CoV-2/Iceland/238/2020__EPI_ISL_417566 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1133 - protein, 1273 aa, synthetic construct
  REGION 1..1273: note = SARS-CoV-2/Greece/16/2020__EPI_ISL_418265 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1134 - protein, 1273 aa, synthetic construct
  REGION 1..1273: note = SARS-CoV-2/Iceland/319/2020__EPI_ISL_417648 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1135 - protein, 1273 aa, synthetic construct
  REGION 1..1273: note = SARS-CoV-2/Congo/94/2020__EPI_ISL_417947 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1136 - protein, 1273 aa, synthetic construct
  REGION 1..1273: note = SARS-CoV-2/Congo/158/2020__EPI_ISL_417950 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1137 - protein, 1273 aa, synthetic construct
  REGION 1..1273: note = SARS-CoV-2/USA/UT-00034/2020__EPI_ISL_417977 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1138 - protein, 1273 aa, synthetic construct
  REGION 1..1273: note = SARS-CoV-2/USA/UT-00033/2020__EPI_ISL_417976 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1139 - protein, 1273 aa, synthetic construct
  REGION 1..1273: note = SARS-CoV-2/USA/WI-13/2020__EPI_ISL_417516 spike protein (1-1273)(A972C_R995C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1140 - protein, 1272 aa, synthetic construct
  REGION 1..1272: note = SARS-CoV-2/India/1-27/2020__EPI_ISL_413522 spike protein (1-1272)(A971C_R994C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1141 - protein, 1267 aa, synthetic construct
  REGION 1..1267: note = SARS-CoV-2/pangolin/Guangxi/P4L/2017__EPI_ISL_410538 spike protein (1-1267)(A966C_R989C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 1142 - protein, 1267 aa, synthetic construct
  REGION 1..1267: note = SARS-CoV-2/pangolin/Guangxi/P5L/2017__EPI_ISL_410540 spike protein (1-1267)(A966C_R989C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 1143 - protein, 1267 aa, synthetic construct
  REGION 1..1267: note = SARS-CoV-2/pangolin/Guangxi/P5E/2017__EPI_ISL_410541 spike protein (1-1267)(A966C_R989C)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 1144 - protein, 1265 aa, synthetic construct
  REGION 1..1265: note = SARS-CoV-2/pangolin/Guangxi/P1E/2017__EPI_ISL_410539 spike protein (1-1265)(A964C_R987C)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGCISSVLNDILSRLDKVEAEVQIDCLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 1145 - protein, 1273 aa, synthetic construct
  REGION 1..1273: note = SARS-CoV-2/Wuhan/WIV05/2019__EPI_ISL_402128 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1146 - protein, 1269 aa, synthetic construct
  REGION 1..1269: note = SARS-CoV-2/bat/Yunnan/RaTG13/2013__EPI_ISL_402131 spike protein (1-1269)(A886C_V1036C)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 1147 - protein, 1273 aa, synthetic construct
  REGION 1..1273: note = SARS-CoV-2/Wuhan/HBCDC-HB-01/2019__EPI_ISL_402132 spike protein (1-1273)(A890C_V1040C)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1148 - protein, 1273 aa, synthetic construct
  REGION 1..1273: note = SARS-CoV-2/Guangdong/20SF028/2020__EPI_ISL_403936 spike protein (1-1273)(A890C_V1040C)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1149 - protein, 1273 aa, synthetic construct
  REGION 1..1273: note = SARS-CoV-2/Shenzhen/SZTH-001/2020__EPI_ISL_406592 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 1150 - protein, 1273 aa, synthetic construct
  REGION 1..1273: note = SARS-CoV-2/Shenzhen/SZTH-004/2020__EPI_ISL_406595 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1151 - protein, 1273 aa, synthetic construct
  REGION 1..1273: note = SARS-CoV-2/France/IDF0372/2020__EPI_ISL_406596 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1152 - protein, 1273 aa, synthetic construct
  REGION 1..1273: note = SARS-CoV-2/Australia/VIC01/2020__EPI_ISL_406844 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1153 - protein, 1273 aa, synthetic construct
  REGION 1..1273: note = SARS-CoV-2/Germany/BavPat1/2020__EPI_ISL_406862 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1154 - protein, 1273 aa, synthetic construct
  REGION 1..1273: note = SARS-CoV-2/Wuhan/HBCDC-HB-02/2020__EPI_ISL_412978 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1155 - protein, 1273 aa, synthetic construct
  REGION 1..1273: note = SARS-CoV-2/Australia/QLD02/2020__EPI_ISL_407896 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1156 - protein, 1273 aa, synthetic construct
  REGION 1..1273: note = SARS-CoV-2/India/1-31/2020__EPI_ISL_413523 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1157 - protein, 1273 aa, synthetic construct
  REGION 1..1273: note SARS-CoV-2/Guangdong/GD2020087-P0008/2020__EPI_ISL_413863 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1158 - protein, 1273 aa, synthetic construct
  REGION 1..1273: note = SARS-CoV-2/Sweden/01/2020__EPI_ISL_411951 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1159 - protein, 1273 aa, synthetic construct
  REGION 1..1273: note = SARS-CoV-2/Tianmen/HBCDC-HB-07/2020__EPI_ISL_412983 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1160 - protein, 1273 aa, synthetic construct
  REGION 1..1273: note = SARS-CoV-2/Hong Kong/case42_VM20002493/2020__EPI_ISL_414527 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1161 - protein, 1273 aa, synthetic construct
  REGION 1..1273: note = SARS-CoV-2/USA/CruiseA-23/2020__EPI_ISL_414482 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1162 - protein, 1273 aa, synthetic construct
  REGION 1..1273: note = SARS-CoV-2/Hong Kong/case85_VM20002868/2020__EPI_ISL_414519 spike protein (1-1273)(A890C_V1040C)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1163 - protein, 1273 aa, synthetic construct
  REGION 1..1273: note = SARS-CoV-2/England/200990660/2020__EPI_ISL_414523 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 1164 - protein, 1273 aa, synthetic construct
  REGION 1..1273: note = SARS-CoV-2/Australia/NSW09/2020__EPI_ISL_413595 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1165 - protein, 1273 aa, synthetic construct
  REGION 1..1273: note = SARS-CoV-2/Australia/NSW10/2020__EPI_ISL_413596 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 1166 - protein, 1273 aa, synthetic construct
  REGION 1..1273: note SARS-CoV-2/Switzerland/1000477797/2020__EPI_ISL_413023 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1167 - protein, 1273 aa, synthetic construct
  REGION 1..1273: note = SARS-CoV-2/Belgium/BA-02291/2020__EPI_ISL_415159 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1168 - protein, 1273 aa, synthetic construct
  REGION 1..1273: note = SARS-CoV-2/USA/WA8-UW5/2020__EPI_ISL_413486 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1169 - protein, 1273 aa, synthetic construct
  REGION 1..1273: note = SARS-CoV-2/England/20102000506/2020__EPI_ISL_415147 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1170 - protein, 1273 aa, synthetic construct
  REGION 1..1273: note = SARS-CoV-2/Belgium/VAG-03013/2020__EPI_ISL_415155 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1171 - protein, 1273 aa, synthetic construct
  REGION 1..1273: note = SARS-CoV-2/Belgium/BC-03016/2020__EPI_ISL_415157 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1172 - protein, 1273 aa, synthetic construct
  REGION 1..1273: note = SARS-CoV-2/Germany/BavPat3/2020__EPI_ISL_414521 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1173 - protein, 1273 aa, synthetic construct
  REGION 1..1273: note = SARS-CoV-2/France/HF1805/2020__EPI_ISL_414628 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1174 - protein, 1273 aa, synthetic construct
  REGION 1..1273: note SARS-CoV-2/Netherlands/ZuidHolland_9/2020__EPI_ISL_414445 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1175 - protein, 1273 aa, synthetic construct
  REGION 1..1273: note = SARS-CoV-2/Finland/FIN03032020A/2020__EPI_ISL_413602 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1176 - protein, 1273 aa, synthetic construct
  REGION 1..1273: note = SARS-CoV-2/France/GE1977/2020__EPI_ISL_414632 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1177 - protein, 1273 aa, synthetic construct
  REGION 1..1273: note = SARS-CoV-2/Finland/FIN-313/2020__EPI_ISL_414641 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1178 - protein, 1273 aa, synthetic construct
  REGION 1..1273: note SARS-CoV-2/Netherlands/ZuidHolland_2/2020__EPI_ISL_414556 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1179 - protein, 1273 aa, synthetic construct
  REGION 1..1273: note = SARS-CoV-2/USA/WA-UW31/2020__EPI_ISL_414618 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1180 - protein, 1273 aa, synthetic construct
  REGION 1..1273: note = SARS-CoV-2/South Korea/SNU01/2020__EPI_ISL_411929 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1181 - protein, 1273 aa, synthetic construct
  REGION 1..1273: note = SARS-CoV-2/China/WF0004/2020__EPI_ISL_413694 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1182 - protein, 1273 aa, synthetic construct
  REGION 1..1273: note = SARS-CoV-2/China/WF0028/2020__EPI_ISL_413791 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1183 - protein, 1273 aa, synthetic construct
  REGION 1..1273: note = SARS-CoV-2/2019-nCoV/USA-CruiseA-18/2020__MT159716.1 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1184 - protein, 1273 aa, synthetic construct
  REGION 1..1273: note SARS-CoV-2/SARS-CoV-2/Yunnan-01/human/2020/CHN__MT049951.1 spike protein (1-1273)(A890C_V1040C)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1185 - protein, 1273 aa, synthetic construct
  REGION 1..1273: note = SARS-CoV-2/USA/WA-UW292/2020__EPI_ISL_418077 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1186 - protein, 1273 aa, synthetic construct
  REGION 1..1273: note = SARS-CoV-2/Iceland/192/2020__EPI_ISL_417819 spike protein (1-1273)(A890C_V1040C)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1187 - protein, 1273 aa, synthetic construct
  REGION 1..1273: note = SARS-CoV-2/Belgium/ULG-6939/2020__EPI_ISL_417020 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1188 - protein, 1273 aa, synthetic construct
  REGION 1..1273: note = SARS-CoV-2/France/HF2496/2020__EPI_ISL_418231 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1189 - protein, 1273 aa, synthetic construct
  REGION 1..1273: note = SARS-CoV-2/USA/WA-UW291/2020__EPI_ISL_418076 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1190 - protein, 1273 aa, synthetic construct
  REGION 1..1273: note = SARS-CoV-2/Portugal/PT0034/2020__EPI_ISL_418019 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 1191 - protein, 1273 aa, synthetic construct
  REGION 1..1273: note = SARS-CoV-2/Iceland/202/2020__EPI_ISL_417750 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1192 - protein, 1273 aa, synthetic construct
  REGION 1..1273: note = SARS-CoV-2/USA/WA-UW261/2020__EPI_ISL_418046 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1193 - protein, 1273 aa, synthetic construct
  REGION 1..1273: note = SARS-CoV-2/Portugal/PT0035/2020__EPI_ISL_418020 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1194 - protein, 1273 aa, synthetic construct
  REGION 1..1273: note = SARS-CoV-2/USA/NY-NYUMC7/2020__EPI_ISL_418192 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1195 - protein, 1273 aa, synthetic construct
  REGION 1..1273: note = SARS-CoV-2/Iceland/189/2020__EPI_ISL_417709 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1196 - protein, 1273 aa, synthetic construct
  REGION 1..1273: note = SARS-CoV-2/Australia/NSW56/2020__EPI_ISL_417408 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1197 - protein, 1273 aa, synthetic construct
  REGION 1..1273: note = SARS-CoV-2/Iceland/280/2020__EPI_ISL_417608 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1198 - protein, 1273 aa, synthetic construct
  REGION 1..1273: note = SARS-CoV-2/Iceland/247/2020__EPI_ISL_417575 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 1199 - protein, 1273 aa, synthetic construct
  REGION 1..1273: note = SARS-CoV-2/Iceland/238/2020__EPI_ISL_417566 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1200 - protein, 1273 aa, synthetic construct
  REGION 1..1273: note = SARS-CoV-2/Greece/16/2020__EPI_ISL_418265 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1201 - protein, 1273 aa, synthetic construct
  REGION 1..1273: note = SARS-CoV-2/Iceland/319/2020__EPI_ISL_417648 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1202 - protein, 1273 aa, synthetic construct
  REGION 1..1273: note = SARS-CoV-2/Congo/94/2020__EPI_ISL_417947 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1203 - protein, 1273 aa, synthetic construct
  REGION 1..1273: note = SARS-CoV-2/Congo/158/2020__EPI_ISL_417950 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFLSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1204 - protein, 1273 aa, synthetic construct
  REGION 1..1273: note = SARS-CoV-2/USA/UT-00034/2020__EPI_ISL_417977 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1205 - protein, 1273 aa, synthetic construct
  REGION 1..1273: note = SARS-CoV-2/USA/UT-00033/2020__EPI_ISL_417976 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1206 - protein, 1273 aa, synthetic construct
  REGION 1..1273: note = SARS-CoV-2/USA/WI-13/2020__EPI_ISL_417516 spike protein (1-1273)(A890C_V1040C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 1207 - protein, 1272 aa, synthetic construct
  REGION 1..1272: note = SARS-CoV-2/India/1-27/2020__EPI_ISL_413522 spike protein (1-1272)(A889C_V1039C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGCGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRCDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

(The sequence listing continues in the following parts.)

The invention claimed is:

1. A purified mRNA comprising:
   (a) a 5' cap structure;
   (b) a heterologous 5' untranslated region (UTR);
   (c) a coding sequence encoding a SARS-CoV-2 spike protein (S) at least 95% identical to SEQ ID NO: 10 that is a pre-fusion stabilized spike protein (S_stab) comprising K986P and V987P stabilizing substitutions and further comprising a D614G amino acid substitution relative to SEQ ID NO: 10; and
   (d) a heterologous 3' UTR,
   wherein the mRNA optionally comprises a nucleotide substitution at one or more uracil position(s) selected from a 1-methylpseudouridine or a pseudouridine substitution.

2. The purified mRNA of claim 1, wherein the 3' UTR comprises at least one poly(A) sequence comprising 30 to 200 adenosine nucleotides.

3. The purified mRNA of claim 2, wherein the 5' cap is a m7G, cap0, cap1, cap2, a modified cap0 or a modified cap1 structure.

4. The purified mRNA of claim 3, wherein the 5' cap is a cap1 structure.

5. The purified mRNA of claim 2, wherein the mRNA comprises a terminal poly(A) sequence of 30 to 200 adenosine nucleotides.

6. The purified mRNA of claim 2, wherein the at least one coding sequence of the mRNA has a G/C content of at least about 50%.

7. The purified mRNA of claim 6, wherein the mRNA comprises an RNA sequence at least 80% identical to SEQ ID NO: 23092.

8. The purified mRNA of claim 2, wherein the spike protein comprises the D614G amino acid substitution and a E484K amino acid substitution relative to SEQ ID NO: 10.

9. The purified mRNA of claim 8, comprising at least one of the following amino acid substitutions relative to SEQ ID NO: 10: L18F, D80A, D215G, delL242, delA243, delL244, R246I, K417N, N501Y and/or A701V.

10. The purified mRNA of claim 9, wherein the spike protein comprises the following amino acid substitutions relative to SEQ ID NO: 10: L18F, D80A, D215G, delL242, delA243, delL244, R246I, K417N, E484K, N501Y, D614G and A701V.

11. The purified mRNA of claim 2, wherein the mRNA comprises a 1-methylpseudouridine nucleotide substitution at one or more uracil position(s).

12. The purified mRNA of claim 11, wherein 100% of the uracil positions in the coding sequence are replaced with 1-methylpseudouridine.

13. The purified mRNA of claim 2, wherein the mRNA is a purified mRNA that has been purified by RP-HPLC and/or TFF.

14. A pharmaceutical composition comprising the purified mRNA of claim 1 and at least one pharmaceutically acceptable carrier.

15. The composition of claim 14, wherein the composition comprises at least two different mRNA encoding at least two different SARS-CoV-2 spike proteins.

16. The composition of claim 15, wherein the at least two different SARS-CoV-2 spike proteins are each at least 95% identical to SEQ ID NO: 10 and comprise the K986P and V987P stabilizing substitutions.

17. The composition of claim 16, wherein the at least two different SARS-CoV-2 spike proteins are from different SARS CoV-2 variants.

18. The composition of claim 14, wherein the mRNA is complexed or associated with lipid nanoparticles (LNPs).

19. The composition of claim 18, wherein the LNPs comprises:
   (i) at least one cationic lipid;
   (ii) at least one neutral lipid;
   (iii) at least one steroid or steroid analogue; and
   (iv) at least one PEG-lipid,
   wherein (i) to (iv) are in a molar ratio of about 20-60% cationic lipid, 5-25% neutral lipid, 25-55% sterol, and 0.5-10% PEG-lipid.

20. The composition of claim 19, wherein the at least one PEG-lipid is present in the LNPs in a molar ratio of about 0.5% to 5%.

21. The composition of claim 20, wherein the at least one PEG-lipid comprises PEG-DMG or PEG-cDMA.

22. The composition of claim 21, wherein the at least one PEG-lipid comprises PEG-2000-DMG.

23. The composition of claim 18, wherein the LNPs have a mean diameter of from about 60 nm to 200 nm.

24. The composition of claim 18, wherein the composition has a lipid to RNA molar ratio (N/P ratio) of from about 2 to about 12.

25. The composition of claim 20, further comprising sucrose.

26. A composition comprising:
   (I) a purified mRNA comprising:
   (a) a 5' cap structure;
   (b) a heterologous 5' untranslated region (UTR);
   (c) a coding sequence encoding a SARS-CoV-2 spike protein (S) at least 95% identical to SEQ ID NO: 10 that is a pre-fusion stabilized spike protein (S_stab) comprising K986P and V987P stabilizing substitutions and further comprising a D614G amino acid substitution relative to SEQ ID NO: 10; and
   (d) a heterologous 3' UTR, comprising a terminal poly(A) sequence of 30 to 200 adenosine nucleotides,
   wherein 100% of the uracil positions in the mRNA are replaced with 1-methylpseudouridine; and (II) at least one pharmaceutically acceptable carrier,
wherein the mRNA is complexed or associated with lipid nanoparticles (LNPs).

27. The composition of claim 26, wherein the LNPs comprises:
(i) at least one cationic lipid;
(ii) at least one neutral lipid;
(iii) at least one steroid or steroid analogue; and
(iv) at least one PEG-lipid,
wherein (i) to (iv) are in a molar ratio of about 20-60% cationic lipid, 5-25% neutral lipid, 25-55% sterol, and 0.5-5% PEG-lipid.

28. The composition of claim 27, wherein the at least one PEG-lipid comprises PEG-2000-DMG.

29. The composition of claim 27, wherein the spike protein comprises the D614G substitution and a E484K substitution relative to SEQ ID NO: 10.

30. A method of stimulating an immune response to a coronavirus spike protein in a subject comprising administering to the subject an effective amount of a composition according to claim 27.

* * * * *